United States Patent 6,900,016 (POLYMORPHISMS IN KNOWN GENES ASSOCIATED WITH INFLAMMATORY AUTOIMMUNE DISEASE, METHODS OF DETECTION AND USES THEREOF) - sequence listing, part 6

SEQ ID NO: 7220 - DNA, 601 bp, Human
agtctttgctgagtggctctgtgtgtgtgcttgggcacacctccaacacagagccaggctgtttgtgactctcagctttcacttcccgtttgtgcagtgcgttgagctgagccacagatgagagctgagggcctcccgaggtctttcctgagccctgtacatgtgtgtggccttctagattcccaggaatatgttggagcttttcaaagccccctgaggatatctcattccccagcttaaaactttggttatcctatcatttgctccgaccattattctctgtcttagaaaactgtgatgktcaacaattacctctgattgtttttgacagacaccaccagggaaaaggctgtttgtattacatgagctcagataaagtcttttgagtgtggtctaccagaggattcccagacagatgagataagcacagtttctggagtggggcttttcaggaatgccaaccctgttctgcaccccccggggctggcaggtgctggttttcaccctgacttcaggctgagggtttcaaggctgccatagggatggctgggaatagggcaggtttcagtgccaccgagctcccgtgctgacggggattcag

SEQ ID NO: 7221 - DNA, 601 bp, Human; identical to SEQ ID NO: 1940

SEQ ID NO: 7222 - DNA, 601 bp, Human; identical to SEQ ID NO: 1941

SEQ ID NO: 7223 - DNA, 601 bp, Human; identical to SEQ ID NO: 1942

SEQ ID NO: 7224 - DNA, 601 bp, Human; identical to SEQ ID NO: 1943

SEQ ID NO: 7225 - DNA, 601 bp, Human; identical to SEQ ID NO: 1944

SEQ ID NO: 7226 - DNA, 601 bp, Human; identical to SEQ ID NO: 1945

SEQ ID NO: 7227 - DNA, 601 bp, Human; identical to SEQ ID NO: 1946

SEQ ID NO: 7228 - DNA, 601 bp, Human; identical to SEQ ID NO: 1947

SEQ ID NO: 7229 - DNA, 601 bp, Human; identical to SEQ ID NO: 1948

SEQ ID NO: 7230 - DNA, 601 bp, Human; identical to SEQ ID NO: 1949

SEQ ID NO: 7231 - DNA, 601 bp, Human; identical to SEQ ID NO: 1950

SEQ ID NO: 7232 - DNA, 601 bp, Human; identical to SEQ ID NO: 1951

SEQ ID NO: 7233 - DNA, 601 bp, Human; identical to SEQ ID NO: 1952

SEQ ID NO: 7234 - DNA, 601 bp, Human; identical to SEQ ID NO: 1953

SEQ ID NO: 7235 - DNA, 601 bp, Human; identical to SEQ ID NO: 1954

SEQ ID NO: 7236 - DNA, 601 bp, Human; identical to SEQ ID NO: 1955

SEQ ID NO: 7237 - DNA, 601 bp, Human; identical to SEQ ID NO: 1956

SEQ ID NO: 7238 - DNA, 601 bp, Human; identical to SEQ ID NO: 1957

SEQ ID NO: 7239 - DNA, 601 bp, Human; identical to SEQ ID NO: 1958

SEQ ID NO: 7240 - DNA, 601 bp, Human; identical to SEQ ID NO: 1959

SEQ ID NO: 7241 - DNA, 601 bp, Human; identical to SEQ ID NO: 1145

SEQ ID NO: 7242 - DNA, 601 bp, Human; identical to SEQ ID NO: 1146

SEQ ID NO: 7243 - DNA, 601 bp, Human; identical to SEQ ID NO: 1147

SEQ ID NO: 7244 - DNA, 601 bp, Human; identical to SEQ ID NO: 1148

SEQ ID NO: 7245 - DNA, 601 bp, Human; identical to SEQ ID NO: 1149

SEQ ID NO: 7246 - DNA, 601 bp, Human; identical to SEQ ID NO: 1150

SEQ ID NO: 7247 - DNA, 601 bp, Human; identical to SEQ ID NO: 1151

SEQ ID NO: 7248 - DNA, 601 bp, Human; identical to SEQ ID NO: 1152

SEQ ID NO: 7249 - DNA, 601 bp, Human; identical to SEQ ID NO: 1153

SEQ ID NO: 7250 - DNA, 601 bp, Human; identical to SEQ ID NO: 1154

SEQ ID NO: 7251 - DNA, 601 bp, Human; identical to SEQ ID NO: 1155

SEQ ID NO: 7252 - DNA, 601 bp, Human; identical to SEQ ID NO: 1156

SEQ ID NO: 7253 - DNA, 601 bp, Human; identical to SEQ ID NO: 1157

SEQ ID NO: 7254 - DNA, 601 bp, Human; identical to SEQ ID NO: 1158

SEQ ID NO: 7255 - DNA, 601 bp, Human; identical to SEQ ID NO: 1159

SEQ ID NO: 7256 - DNA, 601 bp, Human; identical to SEQ ID NO: 1160

SEQ ID NO: 7257 - DNA, 601 bp, Human; identical to SEQ ID NO: 1161

SEQ ID NO: 7258 - DNA, 601 bp, Human; identical to SEQ ID NO: 1162

SEQ ID NO: 7259 - DNA, 601 bp, Human; identical to SEQ ID NO: 1163

SEQ ID NO: 7260 - DNA, 601 bp, Human; identical to SEQ ID NO: 1164

SEQ ID NO: 7261 - DNA, 601 bp, Human; identical to SEQ ID NO: 1165

SEQ ID NO: 7262 - DNA, 601 bp, Human; identical to SEQ ID NO: 1166

SEQ ID NO: 7263 - DNA, 601 bp, Human; identical to SEQ ID NO: 1167

SEQ ID NO: 7264 - DNA, 601 bp, Human; identical to SEQ ID NO: 1168

SEQ ID NO: 7265 - DNA, 601 bp, Human; identical to SEQ ID NO: 1169

SEQ ID NO: 7266 - DNA, 601 bp, Human; identical to SEQ ID NO: 1170

SEQ ID NO: 7267 - DNA, 601 bp, Human; identical to SEQ ID NO: 1171

SEQ ID NO: 7268 - DNA, 601 bp, Human; identical to SEQ ID NO: 1172

SEQ ID NO: 7269 - DNA, 601 bp, Human; identical to SEQ ID NO: 1173

SEQ ID NO: 7270 - DNA, 601 bp, Human; identical to SEQ ID NO: 1174

SEQ ID NO: 7271 - DNA, 601 bp, Human; identical to SEQ ID NO: 1175

SEQ ID NO: 7272 - DNA, 601 bp, Human; identical to SEQ ID NO: 1176

SEQ ID NO: 7273 - DNA, 601 bp, Human
cggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactgtgagtgccgcctgggccaggctggggagagggtgtggtgggcgtcagctggcatcttcgttccagctggaccacgccacagcgagcccragagagggatcaggaattggttctgctgtatgaggtgtgtgagaacaatgccgtgctgcctgacctgaaacccagctgcagggatctagaacaaactctaaagagcaactcccatcactgtggttccacccagtttgcaagagggtctcccagtcttgcggttcaccactttctggggttcatctttgctgtgagcacatctgttttctgagtttcctgttaagcttcaagcatatgtccttctcccctctcactctattcctttactctgtttgtttttctgcctttcttcctctgttc

SEQ ID NO: 7274 - DNA, 601 bp, Human
agcgatctcactaggaacagcttttagatggagtgagcgggagggcccttaggagctggccacatccttcacagggctagacaggtccctggttatttgctcttcataaattctagtgtcccctaggagctgactatttttgcctcttcaccacccaggcatctgaggggttgtgatggttaccttcatgtgtcaacttgactggaccatgaggatcccatatatttggtcagacattattctgtgaggatgtttttggggtgagattagcatttgaatcagtagactgaataaagcagawcacattcgggaatgtgggtggctccgtcaatctgcgggaggcccgaatagaacaaaaaggctgaccctaagtaggagaccatttttcctgcctaacgtggctttgaactgggacaccggcttttccttgcctttggacttaaactgaagcatcagctcttcctgcgtcttgagcctgatggcttgggctggaactacaccagcagctctactgagttgccagcttgccgactcacctggcagatttggggacctgccagcttccataataatgtgagcaaattcctatatatgcatatga

SEQ ID NO: 7275 - DNA, 601 bp, Human
cgtcaatctgcgggaggcccgaatagaacaaaaaggctgaccctaagtaggagaccatttttcctgcctaacgtggctttgaactgggacaccggcttttccttgcctttggacttaaactgaagcatcagctcttcctgcgtcttgagcctgatggcttgggctggaactacaccagcagctctactgagttgccagcttgccgactcacctggcagatttggggacctgccagcttccataataatgtgagcaaattcctatatatgcatatgatgcgtaggatgcatatgcacggtaygatgcgtgtttctctggagaaccctgataatacagtggcactaagtacctaagaacagaaagtgcacccttactattatcttggaagtctgtcccattttttatgtatttacgttaccttgaagaggtgtgttataattttttttctttttgctatacttgttttggaggttatgttttataatttttaatagactattgaaaatattaaatctgtccaggagaaacagtcgtctttgcctttgagaaaattatcatcctaaattctaatgtctttaacagaagctttagtcatcagtga

SEQ ID NO: 7276 - DNA, 601 bp, Human
ccctgtcctcccaagttgctggaattacagttgtgagccacaacgcccagccagaatttcaatttttccttttttcctaaccttgaaagccagaatttccatttttaacagattcccgggtgatgcggatgctgctggtctgggttcatcttttgagaggctgtgctccccaaaaaggatatgttgaagtgctatgtccctgtcttagttcattttgggttttgcaataacaagaccacagactgggtaatttatagagaaaataagtttatgtcttacagtgctggaggcaggaagtacmttttgctgcatgtgatgtgagtcttcttactgtcataacatggcaaaaggcatcgcgtggcaagagagggcaagagcccactcccaggagcccttttttaaaggtactaaactgacccatgaaggtggaggagcccttatggcctaaatttcttcttaaagtccctacctctcaacactcttacaatggcaattaaatctcaacttgagttttggagaggacaaacattcaaaccgtagcaccatagtatctcagaacatgacctttttggatatgagattgttttagatgtaattagtt

SEQ ID NO: 7277 - DNA, 601 bp, Human
aaaccgtagcaccatagtatctcagaacatgacctttttggatatgagattgttttagatgtaattagttaagatgaggtcatactggaatagcacagagaacctaatctgataggactggtgtccttataagaaggccctgtggagacagaggaatggagtgaagcatctatacgccaaggaacctgccagaaactaggacagaggcatggagcagattcatcctcagatcccttagaaggaccatccctaccaacgtactgagttaggactgccagcccccaaaactatgtgatagcargttgttgttttaaaccaccccatgtgtggtcctttgttagggcaggcctaggaaactaacacagaggcaccagttaacagaaactagatttcctggactgggagcctactcgcatgttgatctaaaattctataagcaagttagaaacaaaacaaaacataatgcctaattatggtaatgccatcaggtaactgcaaaatgacgcaatacatacatctcactccctgcagatagcctgagcagagaaggattggagcgggggtgggggtttggagtctaacataagataaggaagaaatg

SEQ ID NO: 7278 - DNA, 601 bp, Human
ggaatagcacagagaacctaatctgataggactggtgtccttataagaaggccctgtggagacagaggaatggagtgaagcatctatacgccaaggaacctgccagaaactaggacagaggcatggagcagattcatcctcagatcccttagaaggaccatccctaccaacgtactgagttaggactgccagcccccaaaactatgtgatagcaggttgttgttttaaaccaccccatgtgtggtcctttgttagggcaggcctaggaaactaacacagaggcaccagttaacagaaactrgatttcctggactgggagcctactcgcatgttgatctaaaattctataagcaagttagaaacaaaacaaaacataatgcctaattatggtaatgccatcaggtaactgcaaaatgacgcaatacatacatctcactccctgcagatagcctgagcagagaaggattggagcgggggtgggggtttggagtctaacataagataaggaagaaatggacatcaccaggttctggcctgcttcaggatggtcacctgagtagctctggatcacatgtctgaaaggttaccatgttaagaatta

SEQ ID NO: 7279 - DNA, 601 bp, Human
tataagtaatatttggaatctctgtttatctccaagaaagacccatgatcgtggttaaagtttgggaaactgaggcaatgctgcttagtcacagctccaggcaggtgactattcttagactccttcccagggactagactcttctgcatcactctctggggtggtgcaggtcctgcaaattgttcatacttcctcttagaaactctccctgatctcatatcttcttcttcctgttttggccaactgcttccccaacctgcacatcaagcgggtgtaatggaagagaactttgtggaattgyggctttagctgtcccctcacaggtactggttttgcctcttgcccagttccctctcttcgctgctccagtatgttccccatccttgtcgtgggctccccggcactgtggctgccgccatcctggccaggcagctgcctctctccacccagagccaagtcccttccaggccctgggactgcctgtttggtggtcaggctccactcaaaccttccatttggctttcccccactctggtcatacggagtccacatccaggtcttgctgtgcccagaattctgggatggtgactggagtgagggt

SEQ ID NO: 7280 - DNA, 601 bp, Human
ttagactccttcccagggactagactcttctgcatcactctctggggtggtgcaggtcctgcaaattgttcatacttcctcttagaaactctccctgatctcatatcttcttcttcctgttttggccaactgcttccccaacctgcacatcaagcgggtgtaatggaagagaactttgtggaattgcggctttagctgtcccctcacaggtactggttttgcctcttgcccagttccctctcttcgctgctccagtatgttccccatccttgtcgtgggctccccggcactgtggctgccrccatcctggccaggcagctgcctctctccacccagagccaagtcccttccaggccctgggactgcctgtttggtggtcaggctccactcaaaccttccatttggctttcccccactctggtcatacggagtccacatccaggtcttgctgtgcccagaattctgggatggtgactggagtgagggttggagacaggcagccggggatggttcgtctccagctggtactccaagacggagagtgcctaggccacaggtcatgagagcattgctttattagatcagtatctgcaagcaggtc

SEQ ID NO: 7281 - DNA, 601 bp, Human
agaaatgggctcaaggacctggtcttccctggacgacagaagtgtcattgacgtttcccctaatattttgataggaaaattcaagtagagttgattatttcaaaaatgtagggtagaacgttcactacttttaaggcacttgcacttaggcatgggtcttcccaaactgcctgaagagaggatatggttaaacaactgagtggctttccttggaggaaaagggaaactgcccttcactttacctttctgagtcagccacagtgggcgcctccctgaaatgatctcatttaatccttgcgtgcaactctaggagagtggtgttaccaccctgcaggtaaggaacgctgtgccccctctgtccacatataggtcacaggagccggtagagagatgctcattctcagacagtagcctcttggagagagaattcttttgtttgagttttctaagccctaggattctgctaagccactgtaggattttgcctgcaaggccccattgtctgtgggctggttggccagctttgctcttccttcttgagagtgactttcacattccagtggttctggagacacatttgctcctcctccatttgaaagca

SEQ ID NO: 7282 - DNA, 601 bp, Human
gtcccccttccccaatggcatccttccactgaaaaatgcacaatttgtcactgcatagttagggtccatttgatctcatgccctcttttctcaaagactttctgcccatcagaaattctttaaaagggagtacatttttttggaagcatgatccccttttgtttttcctattttccacttccttattggaatggggaggtagagacatggagggtgagggccagaagtcttggctctttggcaggtgatagctttccattgccagggccacttgcctagcaggaaagctcaacaccacctrcctcttctaccccttgggtgccacatccatctcagaagggatgcgagtggtcttggtgctccttgacatccacgtttataatggatgcaatgggaagagttttcctggagacaggacgcaatccatactcactcccttctcttccttgactctcattcccccttcagatcactttcatctaccttccatttccactactgccactgaaagggtgctgccaaaactttcttatatttattgcaaagtgtattaatttgtatgcagcccatgatactcaattgtcacctcctaatcaattgg

SEQ ID NO: 7283 - DNA, 601 bp, Human
gaccacccaccctatgattttattgacatgaactgtccagagtaggcacatctgtggagacacaaagtagctgcgtggctgccgagggcaggtgggagtgtggtgggaaagtagggtggctactcatggacacagggcttctcttgggggtgataatgttctaaaattagattgtggggatggttgcataaccctgaaaatactaaaacccagtgagtggtacactttaaaagagtgaattgtatggtgcgtgaattatatatcaagaaagatttaatcttggatgactccctcctgccckctgaatgaggtccatgattggtagagtggtgcagagcctttgaacctgtgtccaggcccctccccatattcatccatgtctcttccaccccactttgcctctgccctgatgctccacccacagagaatgtcttgccattgccagatcacacctgttcccctgtagaactcctactcatccatcaaaacccagctcacatgtcaccctctctggatttcctacccactccagttaggtttaattgtttttgtacttgtgttttcctcactttttaggcgtgtgtcgattatagcacatact

SEQ ID NO: 7284 - DNA, 601 bp, Human
tcgattatagcacatactgtactgtattttaaacatttatgtgtctctcctgcagtggactgtgagcttcctgaggatgtgccagtattttactgatttatttttctgtgccaaccttgtaggagaggatgtacatgctagcacactgtcagtgcccagtgaaagtggttgaagttgaattctgtcagggagactggctgggaaacaacagtaaggactctgaggaaccgcaatgaggagctttttcatggcaaggacagtggggtgaagagaggaaacagagccacaggcactgcttccygaaggctctgccttgcacgtgacctgccatactctaagtagtcctctctcatgagaacggggcagtttgtcagcagggctgatttccaccctgggcctgagaggattgagacgcaggaccatgtgttcaagctggatgcatgggatgggaacgagctcaatagaaggacagtcgatgggactccacgggacaggcattgagaacctattatatggccggcattgttatgctagaggccaatgacagtcagaggtgggcggttgaaagtaatgctgctgattgtcgttgtcatctggtaga

SEQ ID NO: 7285 - DNA, 601 bp, Human
agtggggtgaagagaggaaacagagccacaggcactgcttcccgaaggctctgccttgcacgtgacctgccatactctaagtagtcctctctcatgagaacggggcagtttgtcagcagggctgatttccaccctgggcctgagaggattgagacgcaggaccatgtgttcaagctggatgcatgggatgggaacgagctcaatagaaggacagtcgatgggactccacgggacaggcattgagaacctattatatggccggcattgttatgctagaggccaatgacagtcagaggtgggmggttgaaagtaatgctgctgattgtcgttgtcatctggtagagtcatgcccatcacgtaacagctgccaatgcatatttctgcaaagaaggaaagaaagccgatgagctcttcagaagatgagctcttcagacaatcctaagtctcctttacccattacagcatcctccatggcactcaccccaatcttactctggcatgcatgggcccagacagacgatgctgttgaaaaggagatctgaacctcatctgctctccttagaggcctctggtgggggcagatctctgctctcagcccctg

SEQ ID NO: 7286 - DNA, 601 bp, Human
agggagaggggaggaggaaggggaggaggaggaccgggaataggacagggaggaggaggaggaggactgggagtaggacaggtaggaggaagaccaggaagaggacagggaggaggaggaggaggaggagctggtggtggtctgtatttccctggataatagccttcccttgttttcaactagcccaggcagattgattttggaaaaaaaaacccatctatggctctccctgcttggtttactctggccgccttttgttccagtgccagttataattacccaggctgaagagatgcctggmggcccctgcttttccgtttgccccacttttgattggcctaattatttctgtgggtctccaaagcctgggctgaagccattaaagcaaccagagacttggcatgtgctgcggccactctggctgttaagtgtcttgtttctctgtgcctgagcactttctttagttccagcccgggaatctccatgtgtccactggaggatggagctatagtttgtctgtcaggcactttcctttctaccctccctcctccaagtattgcctggagcaaggattccctccctttcctaccctgggacagca

SEQ ID NO: 7287 - DNA, 601 bp, Human
ctttggatgttgaacattagggagtctgcctcttgctttgggtttgaaatcaattgcattcctgatgcaggcagctaaggatccactctgactctgggcttttttctctcatgctaatagtttctcatctgaattcgtttttaacttcacctgaagtggacactgttgagcacccctctctaccctctcctgcctgttagaactgtggcctgggtgactctagaccctcagcctctcatcaccaatccagtaatctgcagttcccccacatccacactgggctcggtagagcctcggcaayatcagagccctttttcacacgttaccacctctctccaagggcatcctttgggcccatggaatgacttgggatgcacattgagccaccattctagaatggctttcatgctggctgccttgcactttttttttttttatttctctgagttgatggcctctaccattttcatttctaaaaggtctctgggaactttaacaaattctgatttcatttctttggagtatttttatggtacctcccccatccatttctctttcccatgcgccctcgctccctatcccctgtggaaacaaaaatgca

SEQ ID NO: 7288 - DNA, 601 bp, Human
cgtttttaacttcacctgaagtggacactgttgagcacccctctctaccctctcctgcctgttagaactgtggcctgggtgactctagaccctcagcctctcatcaccaatccagtaatctgcagttcccccacatccacactgggctcggtagagcctcggcaatatcagagccctttttcacacgttaccacctctctccaagggcatcctttgggcccatggaatgacttgggatgcacattgagccaccattctagaatggctttcatgctggctgccttgcactttttttttttttatttctctgagttgatggcctctaccattttcatttctaaaaggtctctgggaactttaacaaattctgatttcatttctttggagtatttttatggtacctcccccatccatttctctttcccatgcgccctcgctccctatcccctgtggaaacaaaaatgcaagcagagaatcagaaactgagccaatgcccagtgttggggtaggaggctgtggtttctgtgaatccttcgtaggtgtgacaacctcctacaccagacaccctgcagggtgtgagtgtcaccctgctgcctgagca

SEQ ID NO: 7289 - DNA, 601 bp, Human
agaatcagaaactgagccaatgcccagtgttggggtaggaggctgtggtttctgtgaatccttcgtaggtgtgacaacctcctacaccagacaccctgcagggtgtgagtgtcaccctgctgcctgagcagcaggctccggtacctcacaaaacagcactaaaggttgtcttctcctgaaggttgtctcttacaaaccaagtctctgaaccaagagcacattttcaagaactccagtcattttgatgtattcagtgggtagagggaaggtagattctcttccctgaaaggggaagagaggraaaaaaaagattgcttttggtttgttggcttgttttataaatgcctccttatattccacataatgcttcctcaatttaagaaaaaaataggctgggtgctgtagctcacgcctgtaatcctagcactttgggaggccgaggcaggtggattgcctgagctcaggagttcaagaccagcctgggcaacacggtgaaaccctgtctccactaaaatacaaaaaatcagccgggtgtggtggggcgcacctgtaatcccagctactcgggaggttgaggcaagagaattgctagaacccggga

SEQ ID NO: 7290 - DNA, 601 bp, Human
gtttgttggcttgttttataaatgcctccttatattccacataatgcttcctcaatttaagaaaaaaataggctgggtgctgtagctcacgcctgtaatcctagcactttgggaggccgaggcaggtggattgcctgagctcaggagttcaagaccagcctgggcaacacggtgaaaccctgtctccactaaaatacaaaaaatcagccgggtgtggtggggcgcacctgtaatcccagctactcgggaggttgaggcaagagaattgctagaacccgggaggtggcggttgcagtgaccsgagattgcaccactgcaccccagcctgggcggcagagtgagactccatctctaaaaaaaaaataaataataaggactttttaaaaattccatgtcaagctgagaactgcagcctcctgtttgaaaatccgcgcctcagcaaactgccactcaatcatttggccctgaatttgagcatgccatcatttgagtcagtgggttgggtaatcacataaggggcccactaggacttgaaagcacaattgtttattatgctgtgctggtaatgacttccaccttcttaacagctgagtaaagtggt

SEQ ID NO: 7291 - DNA, 601 bp, Human
aatcgctgtcccagaaggcagaatcagcacctatgtgaccagaggtagatctcgggtcgctataggaatgaattttctaactaagagttgtccatcagcaggaacagcagctttcagctgaaggccatacaggcagatgctgtgccttggacactgtaagtctatggtgtgctggtaaagctctaacaacaggctccccaggggagagagccttggttggtaatgtttgcctatttctgtggtataaatgctcccacatggccagtctccagctgccagcatagcatcactaaatgcagartggggaggagatgcacacggtcagctgtctcaggagccccaggttccactgtgatgggctcaggcgatcatcagtatataacgctgccctcgagtagctcccagtgtagagacttgcagggtcttgggtaggcacagtagtgctggagacttctgtgagatgccatctgctgctctgggcccacaggcagccattgttaacatccacaagcccagaaagattaagtactttgcccagggccacacagctgctaaattccacatgctattttattgttctcacatttggtttagaaaatcc

SEQ ID NO: 7292 - DNA, 601 bp, Human
tgcaaggagttattacttattatgggttggattggatactcccccacaaaaaaataatgttgaagtcctaacctccaggacctcagaatgtgtgatcttctttggaaagagatcattcttctcattggttacattctttgcagatgtaaccaagttaaaatgagggcacttgggtgggccctaatccatatgactggtgttctcataaagggggagtgtggatgcagacacagacgtgtgtggagggcggtctacagggagagacgcagggaaagtgccagttgcaggcggggatgggaaygctcgtctacaagcccaggagcacagagattgctggcaaagccccagaagctgggaagtggccagaagggattcccctccaagctttagagggagcatggctctgtagacaccttgattttggacttgtaacctgaaatttctgtcattttaagccacccaatttgtgctactttgttagtgtggctccggcaacctaatacactacctatacctacctaacccttttattttttattgttttttgaatatgtttttaaaaattttatgtagagatgggggtctcactgtgttgccctgg

SEQ ID NO: 7293 - DNA, 601 bp, Human
cctatacctacctaacccttttattttttattgttttttgaatatgtttttaaaaattttatgtagagatgggggtctcactgtgttgccctgggtggtctcaaacttggggcctcaagcaaccccgccttggcctcccgaagtgttgggtttgcaggtgtgaaccaccatgcctgggcctaactctttcaaagtatacatttaggatcaaataaaattggaaatttcagttcctctatcatagtcagtttgacattatattttccaaagatggcttcagtgttatctgctgtcctacctrtagggccaaacacctgaaatcaggagctggattctaaatcccccttcccttggatctggataggcccttttgatgctgtgtgacttctgaggcagcatccacctgcgtgctgggacacttgctctggagccctgacgtgcctgtgaacagtccacttatcttgaggccagtgtgctatgagggagcccaaactagcccagatggagagaccacgcagagacatgagactacaaggagagaggtgcccagacagcccccgagctgcttcagtgcccctgccatttcagcatcagccattgt

SEQ ID NO: 7294 - DNA, 601 bp, Human
ttatggcctataggccaaacccaggttgccacctattttttaactaaagttttattggaacacagccacacccatcatgtacatgtcatctgtggctgctttcatgatacattagcagagctgagtagttgggacagactgcaaggctggcaaagcctaaaatatttaggatctgcccttgatggaagtttggcaggccctgttatgttccctcattgatcagttgctgaatggacagtctctgacctctgtggcctcggctgcgctggagggtccccttctaaggtgccttccttgctcraggctccttggccttgttctccaaggacatctcttcttcctgggtttctccacgtggcacagtggtttggcatcgtcgtacttcttgcatcttacctgagggcttcaggaggtgggacctggaggcccccagtccatgaaaagccacagcagggctggcaaaatcacttgtgccattggtcaaagtgatcatggggcctgcccagattcaagagatggagccacagatgccgcccactgcctgaaggaggatggcacaatcacggtgcagaagagcatgaggatgagatgctgtcagacc

SEQ ID NO: 7295 - DNA, 601 bp, Human
agagatggagccacagatgccgcccactgcctgaaggaggatggcacaatcacggtgcagaagagcatgaggatgagatgctgtcagaccgtcttcggaaaaatgtggaacaccatggcaggccaggtggctgctcggcagtgccgtgtcaatcccagctcacccaggtcaccgctgcagtgcctgtccctccccaactccacccacggtccctgacatcacgtggggagggagtttgagatggccatggtgggaatgtgacacctcgggaatgggctctacccaccccaacgccaaagarcctgctgcacacccctgctgccatgggaggacttctggtttgaagccacatgggaagaaagacagcagcatttattgagcactaagggtcgctacatgtcctggaacctcaggatgactccgtaagctatgatgttaccctttattttatagaaggggagtcagaggctcagcaaggttggaggccctggcaggatttgaaccatggtcccctcgtttttgccatcctgcctcacagaagacggagctggcaggagaaggagatcctgggtctgaagaaagcttaggttggcagggaggg

SEQ ID NO: 7296 - DNA, 601 bp, Human
cgggaatgggctctacccaccccaacgccaaagagcctgctgcacacccctgctgccatgggaggacttctggtttgaagccacatgggaagaaagacagcagcatttattgagcactaagggtcgctacatgtcctggaacctcaggatgactccgtaagctatgatgttaccctttattttatagaaggggagtcagaggctcagcaaggttggaggccctggcaggatttgaaccatggtcccctcgtttttgccatcctgcctcacagaagacggagctggcaggagaaggagatcytgggtctgaagaaagcttaggttggcagggagggagagaaagctggccagagaagagcgggcaaagcctgaggccagggcagcatggggttgccagaaggctggacagtggagtccctggaaaggactcagggccagcagactgcgccagctgtgtgggtgctggaagattcaccccaaccaggcagccaaactcctgacgtttctcattgtctgaaaaatgcatctctgtactctaagacaacacaagcagaatgcgagtgaggtgggctcgggaggccctgaagagggccacggagag

SEQ ID NO: 7297 - DNA, 601 bp, Human
tctggtttgaagccacatgggaagaaagacagcagcatttattgagcactaagggtcgctacatgtcctggaacctcaggatgactccgtaagctatgatgttaccctttattttatagaaggggagtcagaggctcagcaaggttggaggccctggcaggatttgaaccatggtcccctcgtttttgccatcctgcctcacagaagacggagctggcaggagaaggagatcctgggtctgaagaaagcttaggttggcagggagggagagaaagctggccagagaagagcgggcaaagcytgaggccagggcagcatggggttgccagaaggctggacagtggagtccctggaaaggactcagggccagcagactgcgccagctgtgtgggtgctggaagattcaccccaaccaggcagccaaactcctgacgtttctcattgtctgaaaaatgcatctctgtactctaagacaacacaagcagaatgcgagtgaggtgggctcgggaggccctgaagagggccacggagagaaagccggcggctgggcaccacattcacagcagaagtttcagttccttcccctcaccttcttcctggg

SEQ ID NO: 7298 - DNA, 601 bp, Human
aagaaagacagcagcatttattgagcactaagggtcgctacatgtcctggaacctcaggatgactccgtaagctatgatgttaccctttattttatagaaggggagtcagaggctcagcaaggttggaggccctggcaggatttgaaccatggtcccctcgtttttgccatcctgcctcacagaagacggagctggcaggagaaggagatcctgggtctgaagaaagcttaggttggcagggagggagagaaagctggccagagaagagcgggcaaagcctgaggccagggcagcatgggrttgccagaaggctggacagtggagtccctggaaaggactcagggccagcagactgcgccagctgtgtgggtgctggaagattcaccccaaccaggcagccaaactcctgacgtttctcattgtctgaaaaatgcatctctgtactctaagacaacacaagcagaatgcgagtgaggtgggctcgggaggccctgaagagggccacggagagaaagccggcggctgggcaccacattcacagcagaagtttcagttccttcccctcaccttcttcctgggaagcacagtggttaggctcaa

SEQ ID NO: 7299 - DNA, 601 bp, Human
gccatcctgcctcacagaagacggagctggcaggagaaggagatcctgggtctgaagaaagcttaggttggcagggagggagagaaagctggccagagaagagcgggcaaagcctgaggccagggcagcatggggttgccagaaggctggacagtggagtccctggaaaggactcagggccagcagactgcgccagctgtgtgggtgctggaagattcaccccaaccaggcagccaaactcctgacgtttctcattgtctgaaaaatgcatctctgtactctaagacaacacaagcagaaygcgagtgaggtgggctcgggaggccctgaagagggccacggagagaaagccggcggctgggcaccacattcacagcagaagtttcagttccttcccctcaccttcttcctgggaagcacagtggttaggctcaaccaatggaccagttttaggaggaggagcgggcaggaaggggctttcatattggatcctgtaggaagcagtggtatgctacaggggtgacagtggccttctttataacaacactcgttcccgcaagctggaccttacccacgtgccagccttgccagttacacatgt

SEQ ID NO: 7300 - DNA, 601 bp, Human
aaacttgataaagattaacttataaaaactcttattaaaacttccctgttatttgccattcatcgctatcgtggagtttttaggggagcttgttcgtccatccacctgataaagttttgaatgcatgctgtgtgcctggctctggcggggagtggggcatacagcagtagccaatagctggggtgggaggttctgaccactcccctccacccacttacagtctggacagagaaataaactaaaaaaatccgcaaccaacaacatacattttgctttttttgtaaatgtattctttttttttgtttttttgagacagtctcgctctgtcaccaggctgaagggcagtggcacaatcttggctcactgccacctccgtctcccaggttcaagtgattctcctgcctcagtctcccgagtagctgagactacaggcacacgtcaccatgcccagttgttttttgtatttttagtagagacggtgtttctccatgttggccaggatggtctcgatctcttgaccttgtgatccgcccgcctcagcctcccaaagtgctgggattacaggtgtgagccattgcgcccaggctactaaatgtgattt

SEQ ID NO: 7301 - DNA, 601 bp, Human
tccgtctcccaggttcaagtgattctcctgcctcagtctcccgagtagctgagactacaggcacacgtcaccatgcccagttgttttttgtatttttagtagagacggtgtttctccatgttggccaggatggtctcgatctcttgaccttgtgatccgcccgcctcagcctcccaaagtgctgggattacaggtgtgagccattgcgcccaggctactaaatgtgatttttataaatgtgttagtatttacatacaaaccaatactagacaagagaggaaaaaacccttatcagaccatwtattgtgaatttgagttttaaagaattaattaaacatgcaagttatgaacttttcaggtactctctaattgaaataagaagatatacactataaattctgtacaaagctggcttgcagatttttttctcgtcattagagttaagacatcacctctaagtatgtttaattaaaatgttttcaagatacactgatattttcttcacagcatttcatctctgcccctcctctcatttgtgaacacggaaccttaggaaaatggttcccaagtgctttcaagcacaaatgtgtctgaatgcaga

SEQ ID NO: 7302 - DNA, 601 bp, Human; identical to SEQ ID NO: 3218

SEQ ID NO: 7303 - DNA, 601 bp, Human; identical to SEQ ID NO: 3219

SEQ ID NO: 7304 - DNA, 601 bp, Human; identical to SEQ ID NO: 3220

SEQ ID NO: 7305 - DNA, 601 bp, Human; identical to SEQ ID NO: 3221

SEQ ID NO: 7306 - DNA, 601 bp, Human; identical to SEQ ID NO: 3222

SEQ ID NO: 7307 - DNA, 601 bp, Human; identical to SEQ ID NO: 3223

SEQ ID NO: 7308 - DNA, 601 bp, Human; identical to SEQ ID NO: 3224

SEQ ID NO: 7309 - DNA, 601 bp, Human; identical to SEQ ID NO: 3225

SEQ ID NO: 7310 - DNA, 601 bp, Human; identical to SEQ ID NO: 3226

SEQ ID NO: 7311 - DNA, 601 bp, Human; identical to SEQ ID NO: 3227

SEQ ID NO: 7312 - DNA, 601 bp, Human; identical to SEQ ID NO: 3228

SEQ ID NO: 7313 - DNA, 601 bp, Human; identical to SEQ ID NO: 3229

SEQ ID NO: 7314 - DNA, 601 bp, Human; identical to SEQ ID NO: 3230

SEQ ID NO: 7315 - DNA, 601 bp, Human; identical to SEQ ID NO: 3231

SEQ ID NO: 7316 - DNA, 601 bp, Human; identical to SEQ ID NO: 3232

SEQ ID NO: 7317 - DNA, 601 bp, Human; identical to SEQ ID NO: 3233

SEQ ID NO: 7318 - DNA, 601 bp, Human; identical to SEQ ID NO: 3234

SEQ ID NO: 7319 - DNA, 601 bp, Human; identical to SEQ ID NO: 3235

SEQ ID NO: 7320 - DNA, 601 bp, Human; identical to SEQ ID NO: 3236

SEQ ID NO: 7321 - DNA, 601 bp, Human; identical to SEQ ID NO: 3237

SEQ ID NO: 7322 - DNA, 601 bp, Human; identical to SEQ ID NO: 3238

SEQ ID NO: 7323 - DNA, 601 bp, Human; identical to SEQ ID NO: 3239

SEQ ID NO: 7324 - DNA, 601 bp, Human; identical to SEQ ID NO: 3240

SEQ ID NO: 7325 - DNA, 601 bp, Human; identical to SEQ ID NO: 3241

SEQ ID NO: 7326 - DNA, 601 bp, Human; identical to SEQ ID NO: 3242

SEQ ID NO: 7327 - DNA, 601 bp, Human
tcagtcactctgcacacaccgcacccgcagtcactccgcacacaccgggggcacagtgagagcggggagtccagagggacaagacaggcacgcgcccctcaggagacttctggaaatgggagagggatgctgacctgagagtcatagccgtcaattacagtcactgaatgggaccgcgtggtgacaggaaggagtgggtcctgagggcgtggacaggggctgggggcgcccctgcgggaggcattgctggaacctgcaggccaggccccgtcctcagccggacagagtcccgggaggatckccctgccctgttcaggaccggagctcagcggcctccagtgccctcctgcggtgggagcacaatgtctggagctggcgtggaggcccaggagatgggagggtgagcagagcttggtgggcccggccttccccgcagggaaccggggcttcctctcccgtgggcagccaggggagggttccgcagggccggggagaccctccagactggagggcattactgggggcgtcgccctcagaaacgtgaccacaccacatccctcggtttaagtttcctagcagccacatggaagaaggaaaaaga

SEQ ID NO: 7328 - DNA, 601 bp, Human
acccgcagtcactccgcacacaccgggggcacagtgagagcggggagtccagagggacaagacaggcacgcgcccctcaggagacttctggaaatgggagagggatgctgacctgagagtcatagccgtcaattacagtcactgaatgggaccgcgtggtgacaggaaggagtgggtcctgagggcgtggacaggggctgggggcgcccctgcgggaggcattgctggaacctgcaggccaggccccgtcctcagccggacagagtcccgggaggatctccctgccctgttcaggaccggrgctcagcggcctccagtgccctcctgcggtgggagcacaatgtctggagctggcgtggaggcccaggagatgggagggtgagcagagcttggtgggcccggccttccccgcagggaaccggggcttcctctcccgtgggcagccaggggagggttccgcagggccggggagaccctccagactggagggcattactgggggcgtcgccctcagaaacgtgaccacaccacatccctcggtttaagtttcctagcagccacatggaagaaggaaaaagaaacaggaaatgaatttcaataa

SEQ ID NO: 7329 - DNA, 601 bp, Human
tatattcatagggtacaagtgcaattttctccactggtatattacactggggtgaagtcagggtcttcagtgtgtccatcactggagcaaagcacattgtacccatcaaacaaactcccatcctccacgcgcttccctccccttcacccctccaagtccccgttgtccatcattccacactcttcttccctgtgtacacatcatttagtgcccactttaagtgacagcatgtgatatttggttttctgtgtctcagttgtttcacttagcataacggcctccatttccatccatgttgctmcaaaggacatgatttccttctcttttttctttattttttatttttttgtttttgtttctgttttttgagacagagtctcgctcttcgccaggctggaatgcagtgaggcaatctcggctcactgcaacctctgcctcccaggttcaagtgattctcctgcctcagcctcccaagtagctgggactacaggtgcaagccaccatgcccatttttgtatttttagtagagacggggtttcaccatgttggccaggatggtctggatctcctgaccttgtgatctgcccaccttggcctccca

SEQ ID NO: 7330 - DNA, 601 bp, Human
agggtacaagtgcaattttctccactggtatattacactggggtgaagtcagggtcttcagtgtgtccatcactggagcaaagcacattgtacccatcaaacaaactcccatcctccacgcgcttccctccccttcacccctccaagtccccgttgtccatcattccacactcttcttccctgtgtacacatcatttagtgcccactttaagtgacagcatgtgatatttggttttctgtgtctcagttgtttcacttagcataacggcctccatttccatccatgttgctacaaaggacrtgatttccttctcttttttctttattttttatttttttgtttttgtttctgttttttgagacagagtctcgctcttcgccaggctggaatgcagtgaggcaatctcggctcactgcaacctctgcctcccaggttcaagtgattctcctgcctcagcctcccaagtagctgggactacaggtgcaagccaccatgcccatttttgtatttttagtagagacggggtttcaccatgttggccaggatggtctggatctcctgaccttgtgatctgcccaccttggcctcccaaagtgctgg

SEQ ID NO: 7331 - DNA, 601 bp, Human
acagcatgtgatatttggttttctgtgtctcagttgtttcacttagcataacggcctccatttccatccatgttgctacaaaggacatgatttccttctcttttttctttattttttatttttttgtttttgtttctgttttttgagacagagtctcgctcttcgccaggctggaatgcagtgaggcaatctcggctcactgcaacctctgcctcccaggttcaagtgattctcctgcctcagcctcccaagtagctgggactacaggtgcaagccaccatgcccatttttgtatttttaktagagacggggtttcaccatgttggccaggatggtctggatctcctgaccttgtgatctgcccaccttggcctcccaaagtgctgggattacaggcgtgagccaccacgcccaggctgatttccttttcttaatggccaagtagtattccattgtgtatatataccacaatttttaagtccagtcctctgtcggtggacacttagtttgattccctacctttgctactgtgagtagtcctgcagtgaacatacaagtgcaggtatgtttttgacataatgatttattttccttcaggtag

SEQ ID NO: 7332 - DNA, 601 bp, Human
acctttgctactgtgagtagtcctgcagtgaacatacaagtgcaggtatgtttttgacataatgatttattttccttcaggtagatacccagtagtagggttgctggaatgaatgggagttctatttttagtcatttgagaagttgctgtgcgtaatttctctatgttttccatagaggttgtactaatttacatacccaccaacaatgtataaaagttcccctttctctgcatcctctccaacatctgttattttttgactttttaataatggccattctgattggtgttaaggtgataytcattgtggttttaacttgcatgtctctgatgattggtgatgttgaacatgcttttcatgtttgtgggctttctgtcttcttttgaaaaatgtctcttcatgtccttagcccacttttaagtgggattattttggggtttttgttgttcttgttgagttgtttgagttcctggtacattctggatgttagttccctgtcgaatgtagagtttgcgaatattttctctcattctgcaagttgtctgttcactctgttgattatttcttttgctgtgcagaagcttttagtttaagtcctgt

SEQ ID NO: 7333 - DNA, 601 bp, Human
tgagagagaaggatacagtttcatttttctgcaaatagatatccaactttcccaacactctttattgaaaagggtgtcctttttccagtgtatgttcttatcagttttgtcagagaacagttggctgtaagcatgtggctatatgtttctgggttccctattctgttctattccattatctgtttttatgtgggtaccatgctgttttggttgctatagccatctagtgtaatttgaaattaggcaatatgatgtctccagctttgctctttttgcttaggattgctttggctatttaggmccttttgtggtttcatatgaactttagagttgttatttctaattctgtgaaaaatgaggtgagtattttgatggagattgcattgaatctgtagattgtttcaggcagtatggtcattttaacaatattaattcttcccatccgtgagcacaggatgtttttccatttgtttgtgtcatctataatttgtttcattagtgttttttagtttgccttgtagagatctttcacctccttggttaaatatattcctagttttttttttttttttttttttttttggtagctattgtaaatggg

SEQ ID NO: 7334 - DNA, 601 bp, Human
accatagtccaggcaggacatggagtgtttgttgaccgagtgctaagtagatgagcccttataattctgtaggttaacaaaaaatccatattttccccaacactatctaaagatgtttaaatgactgtgcacattctttcagatcatcttttcactggggatacacaaataggtttccctgtcaatgcttgccccagttgaaaccccatctgttcctttgcgaagcatattacacgtgtcactagaagtcatgactgtgagcatttccccagacgtcaataagcagcatgtctgtgaaggkcaggctcctaaaactggctggcctgtggggctccggcttcttgaacacaataagtgaagtggcctttcacctttccatggatttctttctatgtcatggggccaacttgggaatcactgcccacagtctagaatgtagtgttgtgggctgctggtgcacaagagacaccgtgatttctggacccaactcacccttctgcagccacttggtccccagggctcacgttgagatgatggacagctgagtgctgagacacttggccatctttctatatcttttcaatgcatgcacttcattgag

SEQ ID NO: 7335 - DNA, 601 bp, Human
aaactggctggcctgtggggctccggcttcttgaacacaataagtgaagtggcctttcacctttccatggatttctttctatgtcatggggccaacttgggaatcactgcccacagtctagaatgtagtgttgtgggctgctggtgcacaagagacaccgtgatttctggacccaactcacccttctgcagccacttggtccccagggctcacgttgagatgatggacagctgagtgctgagacacttggccatctttctatatcttttcaatgcatgcacttcattgagtccatgagccytgttggtaaggaggagggcagcaagtgtaagtgttgcttttgcagcctccgtcggggtgtccagtagagccaagaccaaaatgcagagatctgacttctgcccctttccctctcagacagaaggccaggtagttagggcaattctcagctcttctgtgaataatttccaacactgcttgcttcttctgtgcctggcactgtgctggttctttccatttggttttctctcacctgctcaagaacctgtgcagggagggtgccattttccatcttgcagatgaggaaacccaggcttgggaa

SEQ ID NO: 7336 - DNA, 601 bp, Human
catgttttgcaagctgtaaagtgcagtgcaaatgtgaggaaacatttttattttatatatatatatgtttttgtttttgttttttttttttttgagatggagtctcattctgtcacccaggctggagtgcagtggcacgatcttggctcactgcaacctctgcctcccaggttcaagcgattcttatgtctcagcctcctgagtatctggaattacaggcatgcaccaccacacctggctgatttttgtatttttagtaaagacggggtttcaccatgttgggcaggctggtctcaaactyctgacctcagatgatccacccacctcagcctcccaaaatgctaggattacaggcatgagccaccatgcctggctgtgaggaagtattgttgatggtggttctcttgactttgaagaggttgaacagtggagagttcatcctgtcggtgaaaggcctctgcctgtgttttgtgcgcgtctgagctctgcaagaggaacgtcctgttcagacgtgtcgggggcaggaaacttcagtcaaggctcagatttcttctaactagggcagtggttcccaaaccttgctgcataatagaattaacct

SEQ ID NO: 7337 - DNA, 601 bp, Human
tggttcccaaaccttgctgcataatagaattaacctgggagcccaggatgtaccccatactgctgacagcagtgtctgtgtgggagctgggcgacaggatattttcaagttttacaggtgattccagagtgtaatggagaaccccttctctttatggacttttcttgtgtccacaaaaaaactagagcatttggcatggatccctggttggagatgcagtgtctgataaggcacctaattcacccccaaagcaagcttgaagccctggcctgcccactgggggatatttcaggaatttaarggaacagagagacgggcagttctgactgcacagcaagcctccactggagcagccacctgggcttcaaccggcagcctaaggcagtggttctcagcaaggcaattttgcctccacccccagcaattgccaatgcctatttggttgtcacaactgggagttagggggtgctactgccacctagtgtgtagaaaccagagatgctactaaaattcctaagaggcacaagacaggcccagcaacagagaattgcctggtgcaaaatgtcagtgttggcaagattgagcaacagtgtctgaatgg

SEQ ID NO: 7338 - DNA, 601 bp, Human
acaggtgattccagagtgtaatggagaaccccttctctttatggacttttcttgtgtccacaaaaaaactagagcatttggcatggatccctggttggagatgcagtgtctgataaggcacctaattcacccccaaagcaagcttgaagccctggcctgcccactgggggatatttcaggaatttaaaggaacagagagacgggcagttctgactgcacagcaagcctccactggagcagccacctgggcttcaaccggcagcctaaggcagtggttctcagcaaggcaattttgcctccwcccccagcaattgccaatgcctatttggttgtcacaactgggagttagggggtgctactgccacctagtgtgtagaaaccagagatgctactaaaattcctaagaggcacaagacaggcccagcaacagagaattgcctggtgcaaaatgtcagtgttggcaagattgagcaacagtgtctgaatgggaccccaggcatgactctgggagtgacttgggttgaggaattgagaggttgctgttaagtagatttcggatatccctaagcttctacaaggatgcaactttgttattgataca

SEQ ID NO: 7339 - DNA, 601 bp, Human
taaagaaacatgacaaaaataagtaaaggcaggtgcaccctttccagcctacaacatgacagttgtgtcaggagacttcacaatagccataccctttaatctaggaactctgttttatgcttaaagatgttcactgcagtattatttataatacagtaataaaaattggaaacacagataacccacgataatgtctagtaaagggtcctacagccatagaatagaatggctttggccttttaaatattttaagaagttttactaataggagtttattgcttggggtgggggggtcactgggcttcaaagcagaagacagattgtatataggtaataatctctactatgttaaaatccatagaaagaaaatgatacaagtgatgtttttcgattttgctattatactcaacattttcttctttaaacattagtgtattttaaaaaatttaattactgtattttttttaaaatgttataacaatgttacgtaatcatttttttaaaaaccacaaactatctagaaataaaatgataattcatttggtttaagtgcttgctgagaagataatgtccaaaatatgctccagatatcccacaaagt

SEQ ID NO: 7340 - DNA, 601 bp, Human
gtggtcttgccaggggcaggggggggccacagattgggataatttctttcctcatgcagaatatagacttggagagacacacttcataaatgcatattaaaaccccttggagttgacctggcaggggtaaaatcatgggtgattgattttcacacccttctgctttggattctgagaactggcctcagaggcactgagcagatgttaataaactctgagagctgcgattcagtctcccctttgtcctggaaagtccagaaagagacaagtcaggtaaaatttccctagccttactcacctkttcttaccagaaattcataaattaccattatgggctcagtgatttctcactctgtaccattatggactgtgtcattatgccagcgaatttggactagaaactcaagggaaaccttttcgtttacaggcaaaacaagcaggggcaagggagatcccgtgagtcgtggttaccattcaagaatgagccttttcatagagtttcctaagtttaaaattcactgtctttcaagcagaggaccagccaaaccagacacgttgggcacagaatctcacgcctctaggctggtgtacatccattacc

SEQ ID NO: 7341 - DNA, 601 bp, Human
cagtctcccctttgtcctggaaagtccagaaagagacaagtcaggtaaaatttccctagccttactcaccttttcttaccagaaattcataaattaccattatgggctcagtgatttctcactctgtaccattatggactgtgtcattatgccagcgaatttggactagaaactcaagggaaaccttttcgtttacaggcaaaacaagcaggggcaagggagatcccgtgagtcgtggttaccattcaagaatgagccttttcatagagtttcctaagtttaaaattcactgtctttcaarcagaggaccagccaaaccagacacgttgggcacagaatctcacgcctctaggctggtgtacatccattacccaggcagcatccattgatagtgaaaggagaagagaagtctggtttttgcacaggctaaaagagcacaatttctttttcctgttagttattaggtctctattacggtccactagtaggaagaaacactattaaggaaggctgaaaggcttcttcgacaggcctcatagctttaccgagtgcataagcctgcttggtcaggtgcgctcaggtttccacacagagaggctgc

SEQ ID NO: 7342 - DNA, 601 bp, Human
tttagaattctgagtttctgggggtgggctctcaccctgtctcagtttgggattttcttttcttctatccattggtacctttgtttttggtgcctagatttttaaaagagatgggaagtgaactattacagctataaaatacaaaatacaaaaatataaaatatattttatagtttataaaatagaaaaaactataaaatacaaaatattattttgtgttttaccattatcctgtggtctttttctctaaaggagaggtcaaggaaaagaatagtcaccttttttttctttgtttttttttgagatgaggtcttgctctgcggctcaggctggagtgcagtggcatagtcagggctcactgcagcgtcaaactcctgggctccggtgatcctcttgcctcagcctcccaagtagctaggactacaggcacgtcagacacgtgtctccacacccacctggctaatttttaacatttgtattagcaactatgtctcaatacattgcccaggctgtctctaactcctggcttttagtgatcttcctactctggcctcccaaagcagtgggattacaggcgtgagccactgcacctggtcagaat

SEQ ID NO: 7343 - DNA, 601 bp, Human
ttaaaagagatgggaagtgaactattacagctataaaatacaaaatacaaaaatataaaatatattttatagtttataaaatagaaaaaactataaaatacaaaatattattttgtgttttaccattatcctgtggtctttttctctaaaggagaggtcaaggaaaagaatagtcaccttttttttctttgtttttttttgagatgaggtcttgctctgcggctcaggctggagtgcagtggcatagtcagggctcactgcagcgtcaaactcctgggctccggtgatcctcttgcctcarcctcccaagtagctaggactacaggcacgtcagacacgtgtctccacacccacctggctaatttttaacatttgtattagcaactatgtctcaatacattgcccaggctgtctctaactcctggcttttagtgatcttcctactctggcctcccaaagcagtgggattacaggcgtgagccactgcacctggtcagaatagtcatcttaatgccctaattaaaggacaacatcccccttagcacccagagtccagtgaaaagtcccccctcatctttatgtagaagcaaagtacagagta

SEQ ID NO: 7344 - DNA, 601 bp, Human
ccgccacgctctagctaggtgagctagcaagctgttcaacagctctgtgcctcagtgtccccgcttgtcaaatggttgagtcagctgctacctcccacgaccgtgataagggttggatgggtcgatgtagatgatgtcccttgcacactgcctgcacacagtaagcaccacgtgtttcctgttattgttggaaccccgcagaccactctggaacagctgtgaggtgcagcagtggcccctgtggctgggcaccctgagtgtcatttgtgatgacagccaccattgagcgctcagtgtgtgyggtgggcactgtgattttacaacacacagtttgtaaaggtttacagaggggaatgttgctgcaggaaacctggattcaaagaggtgagcaacatactaatcagtgcagacctgaggtcctgacctgacctggaaatacctgtgatctgcttttaatcaatgggctcggggggctccagggcagattcctggccagatgggatatgtcctttccacactggctgctgtacctgtgctgagccacctgctttgtagtgcacagggatctccttcccatggggaggcccagggttctaattcc

SEQ ID NO: 7345 - DNA, 601 bp, Human
aaggccacatcgcctctcagtgctcttatctggccttcccagaccgtgaatggtcttccccatcagcttgctaatgtttagtcttcttgtctgatgagaaagtgaaagctaagttgctagggagaaaacagtactggaagaaagaaaagtagaaactaggagatttaccagggcttcaaagagcaacacagttaccaaataacattcattcactcacacactgaaaagatatttccagtgtctactgtaagagctgttctaggcactgcagagaccacagtgaacaaaatcggcagaaccyagccaagaaaccgataagaaaaatgtgtaagtcaggtcaaggggtggcaaacaatggcctacaacccactgcctgcttctgtaaataaagttttattgagacacagctacacactcttgtctgtgcctggtgttcctacatggcagagttgagttgccacagagaccatctggccctctacagaaagggttgctgcctcctggggtaggtgccatgcagggaattgaaacaggatgaagtgagatgagaggatggtggagtctactttcacctggctgatgaggacctctctgatgtgac

SEQ ID NO: 7346 - DNA, 601 bp, Human
tcattcactcacacactgaaaagatatttccagtgtctactgtaagagctgttctaggcactgcagagaccacagtgaacaaaatcggcagaacccagccaagaaaccgataagaaaaatgtgtaagtcaggtcaaggggtggcaaacaatggcctacaacccactgcctgcttctgtaaataaagttttattgagacacagctacacactcttgtctgtgcctggtgttcctacatggcagagttgagttgccacagagaccatctggccctctacagaaagggttgctgcctcctggggtaggtgccatgcagggaattgaaacaggatgaagtgagatgagaggatggtggagtctactttcacctggctgatgaggacctctctgatgtgacactgaaaccaagacctgaagggcaagaagaaggaagcagcccgaggaagggctggaggaagacagaggaatagggagtgcaaggggccgggtagtgaagggttggaggagctcaagcataaaacaacaaagaaggagggtaactgggctagggtcagaggatgtacctgggtgtgcaggcagagaacaatgcccgacatgacccg

SEQ ID NO: 7347 - DNA, 601 bp, Human
agttttattgagacacagctacacactcttgtctgtgcctggtgttcctacatggcagagttgagttgccacagagaccatctggccctctacagaaagggttgctgcctcctggggtaggtgccatgcagggaattgaaacaggatgaagtgagatgagaggatggtggagtctactttcacctggctgatgaggacctctctgatgtgacactgaaaccaagacctgaagggcaagaagaaggaagcagcccgaggaagggctggaggaagacagaggaatagggagtgcaaggggccrggtagtgaagggttggaggagctcaagcataaaacaacaaagaaggagggtaactgggctagggtcagaggatgtacctgggtgtgcaggcagagaacaatgcccgacatgacccgagaggcggcacagctctatagaccttacccagcgggtgaggagtttgggtttgggccaagtgcaggcaggtgtgagatctgccttaggtttaggaattctcccggctgctcagactggagcctcagggtcaggatggggagcagagggacctgataggaggtgatcttggcagccaggggagat

SEQ ID NO: 7348 - DNA, 601 bp, Human
gaccatctggccctctacagaaagggttgctgcctcctggggtaggtgccatgcagggaattgaaacaggatgaagtgagatgagaggatggtggagtctactttcacctggctgatgaggacctctctgatgtgacactgaaaccaagacctgaagggcaagaagaaggaagcagcccgaggaagggctggaggaagacagaggaatagggagtgcaaggggccgggtagtgaagggttggaggagctcaagcataaaacaacaaagaaggagggtaactgggctagggtcagaggatgkacctgggtgtgcaggcagagaacaatgcccgacatgacccgagaggcggcacagctctatagaccttacccagcgggtgaggagtttgggtttgggccaagtgcaggcaggtgtgagatctgccttaggtttaggaattctcccggctgctcagactggagcctcagggtcaggatggggagcagagggacctgataggaggtgatcttggcagccaggggagatgtgacggtgcttggactggggctgtccaggctctattacttagtgagccttgggcaagaataccagggaggctcc

SEQ ID NO: 7349 - DNA, 601 bp, Human
accatctggccctctacagaaagggttgctgcctcctggggtaggtgccatgcagggaattgaaacaggatgaagtgagatgagaggatggtggagtctactttcacctggctgatgaggacctctctgatgtgacactgaaaccaagacctgaagggcaagaagaaggaagcagcccgaggaagggctggaggaagacagaggaatagggagtgcaaggggccgggtagtgaagggttggaggagctcaagcataaaacaacaaagaaggagggtaactgggctagggtcagaggatgtrcctgggtgtgcaggcagagaacaatgcccgacatgacccgagaggcggcacagctctatagaccttacccagcgggtgaggagtttgggtttgggccaagtgcaggcaggtgtgagatctgccttaggtttaggaattctcccggctgctcagactggagcctcagggtcaggatggggagcagagggacctgataggaggtgatcttggcagccaggggagatgtgacggtgcttggactggggctgtccaggctctattacttagtgagccttgggcaagaataccagggaggctcct

SEQ ID NO: 7350 - DNA, 601 bp, Human
ggtttaggaattctcccggctgctcagactggagcctcagggtcaggatggggagcagagggacctgataggaggtgatcttggcagccaggggagatgtgacggtgcttggactggggctgtccaggctctattacttagtgagccttgggcaagaataccagggaggctcctactcctgtgtaaatatttaaaggatgtgattagagctaatacaggtaaatacattctaccctacacacacacacacacacacacacacacacacacacacacacacacacacacacacacacccttrtgaccacctggaaggttctgagtcagaattctgcgctccttggagttcggttctgcctcctcctctccccagcctggtctcgccctgactgcaggaggtcttgcccacaccctggatgccccaggtctcctgagtaccctccagccacacccacagacctaggggacacacactggagagcacttcaaaccatgagccaaaaatgtcggtggcaccatagtcccctctcctctcccctagaggtgttggctgcacatggctcccacctggcccagccagggagggcccgaccagcctggg

SEQ ID NO: 7351 - DNA, 601 bp, Human
gctgtccaggctctattacttagtgagccttgggcaagaataccagggaggctcctactcctgtgtaaatatttaaaggatgtgattagagctaatacaggtaaatacattctaccctacacacacacacacacacacacacacacacacacacacacacacacacacacacacacacccttatgaccacctggaaggttctgagtcagaattctgcgctccttggagttcggttctgcctcctcctctccccagcctggtctcgccctgactgcaggaggtcttgcccacaccctggatrccccaggtctcctgagtaccctccagccacacccacagacctaggggacacacactggagagcacttcaaaccatgagccaaaaatgtcggtggcaccatagtcccctctcctctcccctagaggtgttggctgcacatggctcccacctggcccagccagggagggcccgaccagcctgggcttcgtgccagccaggtctcagggttgtcttgtaacttgtgttaaacacacactgtgtaaggactactgaactccccctccaaataaatcagtcttcctagcaccttctagacctggc

SEQ ID NO: 7352 - DNA, 601 bp, Human
cacctggaaggttctgagtcagaattctgcgctccttggagttcggttctgcctcctcctctccccagcctggtctcgccctgactgcaggaggtcttgcccacaccctggatgccccaggtctcctgagtaccctccagccacacccacagacctaggggacacacactggagagcacttcaaaccatgagccaaaaatgtcggtggcaccatagtcccctctcctctcccctagaggtgttggctgcacatggctcccacctggcccagccagggagggcccgaccagcctgggcttcrtgccagccaggtctcagggttgtcttgtaacttgtgttaaacacacactgtgtaaggactactgaactccccctccaaataaatcagtcttcctagcaccttctagacctggcctggagccctctctgagttggagatagatcattacgtggatgaaagctgctttcccagggagaggcctctgcgccacaacccgtccctacccgccatctggtagtgaaacgtgaaaacgtgcctccaccaatgagggagatatattcggatgtgcttagattccccaaggttcttagtgagcaggac

SEQ ID NO: 7353 - DNA, 601 bp, Human
aaaccatgagccaaaaatgtcggtggcaccatagtcccctctcctctcccctagaggtgttggctgcacatggctcccacctggcccagccagggagggcccgaccagcctgggcttcgtgccagccaggtctcagggttgtcttgtaacttgtgttaaacacacactgtgtaaggactactgaactccccctccaaataaatcagtcttcctagcaccttctagacctggcctggagccctctctgagttggagatagatcattacgtggatgaaagctgctttcccagggagaggcctytgcgccacaacccgtccctacccgccatctggtagtgaaacgtgaaaacgtgcctccaccaatgagggagatatattcggatgtgcttagattccccaaggttcttagtgagcaggacgaggggtcatctgccaggatcagctgagattttcttgtgaagggaaatacccgaggatattttgcttttctttgcctttcaagatgatggtgaattctgtaagtctagatcagcgcagtttcctggcctctcttcccaaagacttggtgaagggtgagtgggcacatcttggccaaggctga

SEQ ID NO: 7354 - DNA, 601 bp, Human
tgtgggattcctgcagaaggaatgagcttgccccattcctgcagacaggacagacgtgtgtgctgaagctcaaagtgtcaagatccacaggcacaaaacaggaagaaagagctgcaggcagattcatggcacagtttctttaccaaaatgggggcacccgggatccagtgactggatttaaccaggagcagttttctgccttcccctggtctcagatgaagcagactcgggccggtaccaagaatctctgtgtggcaggagctgcgttcagggaatagatggggaagtttgcatctacccygtgggatgctcaccatggaaggtgaccactgctcagcacagtggacgcagctcaggtgctcatgcatggcatggtgtgggtatagccttggactcacaaggaagacccagggctgctgcggaaggctggagtaggctgggaggtggaattgctccagggtcggtggcagcgcggcagcatgggcgcacctggtgcacgtggcgctggggacaattcagagccccattccttccagcctgacaggtgccacccccaatgagtaactcctcataatagaatctgtccagcttttttgctgat

SEQ ID NO: 7355 - DNA, 601 bp, Human
cctggtctcagatgaagcagactcgggccggtaccaagaatctctgtgtggcaggagctgcgttcagggaatagatggggaagtttgcatctaccctgtgggatgctcaccatggaaggtgaccactgctcagcacagtggacgcagctcaggtgctcatgcatggcatggtgtgggtatagccttggactcacaaggaagacccagggctgctgcggaaggctggagtaggctgggaggtggaattgctccagggtcggtggcagcgcggcagcatgggcgcacctggtgcacgtggcgytggggacaattcagagccccattccttccagcctgacaggtgccacccccaatgagtaactcctcataatagaatctgtccagcttttttgctgattcaggtaatcagtcagggacattgctatcaagacccccagtcctttcctttccctttggtgctctgtctctgaacctgttgggatttgaggtcagaagaaaacaccagagtacagaccacctcgtgttctacagatcatggtttggtgccgtggcctccaccccagctgccccagcattttacaacacaccttgtgtcacgctc

SEQ ID NO: 7356 - DNA, 601 bp, Human
gtgttctacagatcatggtttggtgccgtggcctccaccccagctgccccagcattttacaacacaccttgtgtcacgctcccttgtagaatttatagacagggacgcacctactacacagatagtttcaaaagatcagtagcatgccctaactgtaatataacacagaccttgtgggagcatgcgcatagtgaaatatgctggatgtcagcatgcatgtgctaggacacaggcaggaggaggctgggaaacccagcaggtccctgcactcacgcacaggatcactgagtgcaacccccayagacgcccacggacactggagggctgggatggcagctccagcaccacagcagcgtgctgagctgatgtccagaaatcggagacagcactcagcaaagataaaaggaaaaaagcaaagtgtagttatttgccaatctataaaatagcagcattcgtggataactcagtatatattaaatactgcccccaaaaccctgtggatgatgtgtaaaatgtagttaagttctcagctcagatgattgtaaacaggcttttcccctatataaatgctcatcagatgctcagaagtcaggggacccag

SEQ ID NO: 7357 - DNA, 601 bp, Human
gatcatggtttggtgccgtggcctccaccccagctgccccagcattttacaacacaccttgtgtcacgctcccttgtagaatttatagacagggacgcacctactacacagatagtttcaaaagatcagtagcatgccctaactgtaatataacacagaccttgtgggagcatgcgcatagtgaaatatgctggatgtcagcatgcatgtgctaggacacaggcaggaggaggctgggaaacccagcaggtccctgcactcacgcacaggatcactgagtgcaacccccacagacgcccayggacactggagggctgggatggcagctccagcaccacagcagcgtgctgagctgatgtccagaaatcggagacagcactcagcaaagataaaaggaaaaaagcaaagtgtagttatttgccaatctataaaatagcagcattcgtggataactcagtatatattaaatactgcccccaaaaccctgtggatgatgtgtaaaatgtagttaagttctcagctcagatgattgtaaacaggcttttcccctatataaatgctcatcagatgctcagaagtcaggggacccaggagaattctt

SEQ ID NO: 7358 - DNA, 601 bp, Human
tcctgggtaagggtgaggaagaggcttcaggctgcacctcacggctccaaacaggtccttgttagggagcagggcaggagtggtgggaagggatggtggcctgtgagggggtgtgacaccagggtggcatggtcagagccacatcacgtaaaccttgagcaggttcccttgggtgcactgaacgccttgcctacactatcctgttaaaagctcttacttggtattagatgtgaaattgttcacatgtctgtatctccccaagaccatggatctgggctgaatctagattttcctgttgtcmgcactgcgcttagcatggggttggagggcctccctaaatgctggttgatgaatgaaggagtgagtgagtagcgaactatttcattctgtggagcctcctgcttctccatatcagatggaaaaagaagaaagtaatgaggatattgtgttcccagccccctctgcagcatggagcttgtacgttggagtgccccttctctcatcctcttgtcccattactgccctaaaggatccagacacctccacacagagagggacagatgctcttgctggtcagacagggctgatcctatttcatgat

SEQ ID NO: 7359 - DNA, 601 bp, Human
aaacaggtccttgttagggagcagggcaggagtggtgggaagggatggtggcctgtgagggggtgtgacaccagggtggcatggtcagagccacatcacgtaaaccttgagcaggttcccttgggtgcactgaacgccttgcctacactatcctgttaaaagctcttacttggtattagatgtgaaattgttcacatgtctgtatctccccaagaccatggatctgggctgaatctagattttcctgttgtccgcactgcgcttagcatggggttggagggcctccctaaatgctggttgrtgaatgaaggagtgagtgagtagcgaactatttcattctgtggagcctcctgcttctccatatcagatggaaaaagaagaaagtaatgaggatattgtgttcccagccccctctgcagcatggagcttgtacgttggagtgccccttctctcatcctcttgtcccattactgccctaaaggatccagacacctccacacagagagggacagatgctcttgctggtcagacagggctgatcctatttcatgattaaatcgaaggcttctacctttcttcatctcctggctttccattttct

SEQ ID NO: 7360 - DNA, 601 bp, Human
tcagcctcccaaagtgctgggattacaggcgtgagccaccgcacccgatttgttgtaggtctgttcctaggcttcttaggttgtcatgtggttgaaaccaaaagtgatggtagatatttttaatactcacatacaggtgacattgccatgaagttaaatcaaaagtgctagtagctatttaacagtaagataaggttcctattccagacctacagttatgaagtggacatttgggccatccaattatgtttttctgataaatttctaaataaagtgtgggggtcacacacacacacacgcrcacacacacacacacacattgaaggcttcacagttgctccatccaacttgtcatgcatcaaaatgcaatggaaataggcagattcttagagacagaaaacatctctatggttgccaggggctgagcaaagaggggaatgaatggcaagtgactgctcacgggtacagagcttccttttgggggtgacacaaatgttctggaaggagacagcagtgatggtcctgcagcactgaaaatacactaaaagcctctgaatttcacagttgaaaatggtgactttgatgttatgtgaattttacc

SEQ ID NO: 7361 - DNA, 601 bp, Human; identical to SEQ ID NO: 3243

SEQ ID NO: 7362 - DNA, 601 bp, Human; identical to SEQ ID NO: 3244

SEQ ID NO: 7363 - DNA, 601 bp, Human; identical to SEQ ID NO: 3245

SEQ ID NO: 7364 - DNA, 601 bp, Human; identical to SEQ ID NO: 3246

SEQ ID NO: 7365 - DNA, 601 bp, Human; identical to SEQ ID NO: 3247

SEQ ID NO: 7366 - DNA, 601 bp, Human
tttgaaaaatacaacgcattgttaactatagtcaccctattctgctattgaacactggaatgtatttcttctatctaactgcatgtttgtacccattaaccaacctatcttcattcccctctccacacacacacacagccttcccagtctctggtatctatcattctactccctacctccataaaatcaacttttttagctcccacatgtgaatgagaacatgcagtatttatctttctgtgcctgggttatttgacttaacataatgacctccagttctatccatgttgctgcaaatgaygtgatttcattctgttttatgtctgtgcataaatagtgttctgttatgtgtataccacgttttctttattcatttgttccttgatggacacttaggtcaattccgtatctttgctattgtgaatagtgctgaagtaaacatgggcgtgcacgtatccctttgatatactgatttcctttcctttggaaaaatgcacagtagtggaattactagatcatatgttagctcaatttttagtctttttgagaaatctccatgctattttccataataactgtactaatttatatttctaccaac

SEQ ID NO: 7367 - DNA, 601 bp, Human
ccacacacacacacagccttcccagtctctggtatctatcattctactccctacctccataaaatcaacttttttagctcccacatgtgaatgagaacatgcagtatttatctttctgtgcctgggttatttgacttaacataatgacctccagttctatccatgttgctgcaaatgatgtgatttcattctgttttatgtctgtgcataaatagtgttctgttatgtgtataccacgttttctttattcatttgttccttgatggacacttaggtcaattccgtatctttgctattgtgratagtgctgaagtaaacatgggcgtgcacgtatccctttgatatactgatttcctttcctttggaaaaatgcacagtagtggaattactagatcatatgttagctcaatttttagtctttttgagaaatctccatgctattttccataataactgtactaatttatatttctaccaacagtatataagaattctcttttctctgcatcattgccagcttctgctattttttttttgtctttttaataatagccattctgattggtgtaagagggtgtctcactgtggttttgatttgcat

SEQ ID NO: 7368 - DNA, 601 bp, Human
ttttacattcttttctggttttgttatcatggcaatgctggtttcatggaataaattaaggagaactcctgccccttcagttttttttggaatagattgaggagaatcattagttcttctgacatccaaacctggacttctctttttggggaggctttttaataccagttcaatctcattactcattattggtctgctctagttttctatttctttctgattcaatctttgtaaattatctgtctaggaatttatccatttcctctagattttccagttagcgtatagttgttcataatarcctctgatgatctttggtatttttgtggcatcagttgtaataccttacttttcatttctcattttgttcttttgggtcttctctctttttttctaggtcagtctagcaaatggtttagcaattttgtttatattataaaagaacaatttttcatttcatcagttctttgtatttttttagtatctgttttgtttagttcttctctgacctttattatttcttttctcctgctaaattgtggtttggcttgtttttgcttctctagttctttgaggtgcatcattcgattgtttatttgaa

SEQ ID NO: 7369 - DNA, 601 bp, Human
agatacttgatatgatttcaattttttttacatttgttgagacttttcatgtgtcctgatatatgttctatcctggagaatgttctgtgtgctgatgagaaaatgcgtattctgtagctgttggataaaatgttctgtaaatgtccgttaggtccacttggtctaacaggcagtttaaattcagtgtttctttgttaattttctgtctgtataatctgcctaatgctgaaagtggggtgttgaattccccaaatattgttgtattgaagtctatctgttcctatagatctaataatatttrctgtaaatatctgcatgctctggtgatggatacatatatgtttagaactgttatatcttcttgctgaattgatcccttttgcattatataatgaccttctttttttttttttgacttaaagtctgttttatctgatataagtacagcaactttcgctcacttttggtttccattttcatggaatatctttttgtatccctttactttcaatctatatgtatctttatagataaaatggatttcttgtcagcagcatatagttgggccatgttttattagtcaaacagccagtctgtatct

SEQ ID NO: 7370 - DNA, 601 bp, Human
gcattatataatgaccttctttttttttttttgacttaaagtctgttttatctgatataagtacagcaactttcgctcacttttggtttccattttcatggaatatctttttgtatccctttactttcaatctatatgtatctttatagataaaatggatttcttgtcagcagcatatagttgggccatgttttattagtcaaacagccagtctgtatcttttaggtggaaaagttaattcatatacattcaaggttattgttaatatgtgagggtttattcctgtcattttattaattgrttttttgttgtttcatatattctttattcctttctccttcattatcattgtggtttggtggctttctgtagttgtaatatttgagtcctttctcttccttaatatgtttcctctaccagtggatttatgctttcgtgtgttttcatgatgaaagaattgtcctttcacttccaggtgtagaactcctttaagcattgtttatagatttgatctagtgatgatcacttcccccagcttgtcttgtttttggggaagactttatttctccttcacttatgaagcataactttgctgtctgta

SEQ ID NO: 7371 - DNA, 601 bp, Human
gtagaactcctttaagcattgtttatagatttgatctagtgatgatcacttcccccagcttgtcttgtttttggggaagactttatttctccttcacttatgaagcataactttgctgtctgtagtatccttggctgacaatttccttctttcagttctttgaatatagcatttcattctctcctggccagtagaatttctgctgagaaatctgctgtgagtctgacgggcgttcccttgtaagtgactagacttttttttttttttttttttttttttttttttttttttctgttttcaracttccctttgtctttgacttttgacaattggactataatgtgccatggagaggaccttttttcgattgtatctgtttggagatctctacagcttcctgcatctggatttccaaatcttttgccaaacctggaaagtttttaacaattattttaataaatagattttttatctccttcagtttctctttacctttgggacaccaaaaacttgaatatttgattgctttatggtgtcccatatgtcacaagagttttgtttatttttttatttttatttttttaatgttgtctgattgggt

SEQ ID NO: 7372 - DNA, 601 bp, Human
ttggttgagtagggcactttggctttgattctgggtgcatgcagtagcatagtggccatacgattttttttcagctgtaagcagctccagtggtgcctgtaattttctcagtggcttagggtatggttgttagtggaggctgtggtaaagtttttctggagatggggataccacgtgggccagtcctcagaacctagtggtggcagtggtgggctgagcatgcctgtccttgggccccagggtggtatatgctggtactgatactagtgggtccaggtaggttgattcttgggcctccagrcagcttgctcaagtgctggtagtagtagcagtgggccaggtgggtagtcaggttctcagttccctgggcagcaggcgtggtgtgagtgatggcagtagtcataatgagacagccctctggctcccaagcaatctgtgctgatgttggcagtggctgcaatgggctaggcaggccagtacctagccctgcaggtggcatatacaggtgagtgccagctgtgatgatagtggtaggttggatgggcgtgacctcaggccactaagaggagtgctcaggtgccagtggtggtggactgggcta

SEQ ID NO: 7373 - DNA, 601 bp, Human
cagtggctgcactgtggctctgctactgggaagagtggtcctgctttcactgtcagcagccatatgcggccagctggggagtgtatgatttgcacatactttagactcagtggacacagcagcagtggctgcagacaggggattctgtccttggggcagatgaaaatgcacagccactactctgctagggacagtggggtctctgtcaatgggttatgcctagaccttggtggcagctgccagccaaggtggtggctgcaggcagagatgtcagtggggctctagggatatagagatgccraggccattgggctacagagcaggatgcagtctacgggtgtttggaacatacaaatggtgccgcactgtagctgcttcggactcagagagtgcgtgggagccagcctgagctccctctctggagcaatactgtcatgcagtctccaggcagctccctcagctaatctcagggcccacatgggtgaagggtccccctgcaccaggggcaaaaattgcgggagttcatggtctgtgtgcattttgctctcttaaaagttgggcttcctctgagctccccagagcagagctggctgtggcagca

SEQ ID NO: 7374 - DNA, 601 bp, Human
gcactgaggggtaaacgaggtgaagggagccttcaaatcctgtaatggaagtggccctggccaggccgccccagaggccagtggtgggcggccacagtcctggcaggatgtggcagtgtagagagggggcatctcaggtccactggaggttccgggagtcctgggagctccaggtggaatctaatctgcagatatttctggggaaatgggcagccttcacagctccagtatgggaaagcaattgcccccacatacaacctttgacccctgcttgacactttcctgcctgaaggaccccacstcctcccagatccaagcacctcctgtgtaggcagaactgctgagctctgcatctcacacccctgcatgcttcttgcttcttctgagcagcctggacagggccctcagtcacctggccaagtcagtccctgttgagccaaattcaggtgacttttcatagtcactgttacattcaatatcctataccctggcacgttccaaaattcatgtatatttattcaggacacaaaatcttttcacccaccttctctcaattaatcctctatgggactttgtgagtttgggaatcacaaacctaatg

SEQ ID NO: 7375 - DNA, 601 bp, Human
aacagacatggatatacatgctgtagatatgtacgcgtgacacaagtcgatctgcacgtcagtagatgtgtgtcttcgttcattttgtgttgctataacagaatacttgagacagggtaattgataagaaaagcggttcatttagctcatggctctgcagactgggaagttcaaggggcgtggcaccagcatctgctttgattctggtgagagcttttgagctgggtctaaatgtgacagaaggtcaaagggtaagtggacacacgggaagggacaaaaacctgctttacatcaatccacrttctcaggacctaatccattcccatgagaactaatccactctcacaagagcaagaacacactcactcactcactcactccctcccaccagcaccaagccatttgggagggatttgcacttaggacccaaacacctcccaccaggcctcacctcccacatcacctcactgagtgatttcaatatgagttttagtggggaacaaaccatacccaagtcataacaagatgtatacacatacagaagaatgccataagtatcactatgcctacttcgaatccgtggaacgctaagagaatttat

SEQ ID NO: 7376 - DNA, 601 bp, Human
attttgtgttgctataacagaatacttgagacagggtaattgataagaaaagcggttcatttagctcatggctctgcagactgggaagttcaaggggcgtggcaccagcatctgctttgattctggtgagagcttttgagctgggtctaaatgtgacagaaggtcaaagggtaagtggacacacgggaagggacaaaaacctgctttacatcaatccacgttctcaggacctaatccattcccatgagaactaatccactctcacaagagcaagaacacactcactcactcactcactccytcccaccagcaccaagccatttgggagggatttgcacttaggacccaaacacctcccaccaggcctcacctcccacatcacctcactgagtgatttcaatatgagttttagtggggaacaaaccatacccaagtcataacaagatgtatacacatacagaagaatgccataagtatcactatgcctacttcgaatccgtggaacgctaagagaatttatgattgaaatttggttagtggtgtttcacgattgttatcatttttctttttctgtaggagttggcgatttcagcgtgtggga

SEQ ID NO: 7377 - DNA, 601 bp, Human; identical to SEQ ID NO: 3248

SEQ ID NO: 7378 - DNA, 601 bp, Human; identical to SEQ ID NO: 3249

SEQ ID NO: 7379 - DNA, 601 bp, Human; identical to SEQ ID NO: 3250

SEQ ID NO: 7380 - DNA, 601 bp, Human; identical to SEQ ID NO: 3251

SEQ ID NO: 7381 - DNA, 601 bp, Human; identical to SEQ ID NO: 3252

SEQ ID NO: 7382 - DNA, 601 bp, Human; identical to SEQ ID NO: 3253

SEQ ID NO: 7383 - DNA, 601 bp, Human; identical to SEQ ID NO: 3254

SEQ ID NO: 7384 - DNA, 601 bp, Human; identical to SEQ ID NO: 3255

SEQ ID NO: 7385 - DNA, 601 bp, Human; identical to SEQ ID NO: 3256

SEQ ID NO: 7386 - DNA, 601 bp, Human; identical to SEQ ID NO: 3257

SEQ ID NO: 7387 - DNA, 601 bp, Human; identical to SEQ ID NO: 3258

SEQ ID NO: 7388 - DNA, 601 bp, Human; identical to SEQ ID NO: 3259

SEQ ID NO: 7389 - DNA, 601 bp, Human
gtatatatgtatatatacatgtattatacatacataaatgtatatatgtatatatacatgtattatacatacataaatgtatatatgtatatatacatgtattatacatacataaatgtatatatgtatatatacgtgtatgcacgtatatatacatgtatatatacatgtatatatgtatatatacgtgtatctacatgtgtacacatgtgtatacgtatacatgtgtacacatgtgtatacgtatacatgtgtacacatgtgtatacgtatacatgtgtacacatgtatgtatgtgtayatatgtatacatgtatatatgtatacatacacgcgcgtgtatatatgtatacatacacgcgcgtgtatatatgtatacatacacgcgcgtgtatatatgtatacatacacgcgcgtgtatatatgtatacatacacgcgcgtgtatatatgtatacatacacgcgcgtgtatatatgtatacatacacgcgcgtgtatatatgtatatatacacatacatacatgtattatacatataaacatatacaaatatatgtatatattatatatatgtatatatacacatatatacatgtattt

SEQ ID NO: 7390 - DNA, 601 bp, Human
aatgtatatatgtatatatacatgtattatacatacataaatgtatatatgtatatatacatgtattatacatacataaatgtatatatgtatatatacatgtattatacatacataaatgtatatatgtatatatacgtgtatgcacgtatatatacatgtatatatacatgtatatatgtatatatacgtgtatctacatgtgtacacatgtgtatacgtatacatgtgtacacatgtgtatacgtatacatgtgtacacatgtgtatacgtatacatgtgtacacatgtatgtatgtrtacatatgtatacatgtatatatgtatacatacacgcgcgtgtatatatgtatacatacacgcgcgtgtatatatgtatacatacacgcgcgtgtatatatgtatacatacacgcgcgtgtatatatgtatacatacacgcgcgtgtatatatgtatacatacacgcgcgtgtatatatgtatacatacacgcgcgtgtatatatgtatatatacacatacatacatgtattatacatataaacatatacaaatatatgtatatattatatatatgtatatatacacatatatacatgta

SEQ ID NO: 7391 - DNA, 601 bp, Human
ggatagcaaagagggaatgaatgggtagaaggacaaagagtgcagcagaaaagaggtcaggaaatgaatcatgggcctatcacacagggtcttataaggattttagcttttactcccagataccctgctacaatggtctgagcagagatgacatcatcttacttattttactaggtccactcccgctgctgtattgagaacagcctggaagacaagaatagaaagcaggaggcctgttagagagctggtggtgagtcacaacagggtggtagcagagggaggaagtgagaagggactggaytttggatatattatgaaggtagagccttcagttaatactttctttaaaaatactggtaattttacagttgaccatacactttaggtaataaacaagatttaacatgcctaaaatcacaataactgatcacttacagagtcagtattctttgtgtggttgagattatccttatctagtagcatcataatttaaggtacatttaaaaaatactattttctttaaagcatagagtcactccccagtctgcattagaattgctttaagtaaaagtagcaaattatttacttatttatccaaggg

SEQ ID NO: 7392 - DNA, 601 bp, Human
tgaggatttggtgctcagtttctcatatgccccagaagggtaagccttattttctagaatataatgactttagttgatgtgctgagaaataattagccttccaggttaagtcaatctaatttactaaagtttagaaaggagttgtcgggccgggcgtggtggctcatgtctgtaatcccagcattttgggaggcaaagagggcagatcacctgaggtcaggagttcgagaccagcctgaccaacatggagaaaccccatctctactaaaaacacaaaattagccgggcatggtgatgcatkcctgtaatcccagctacttgggaggctgaggcaggagaatcgcttgaacccaggaggcagaggttgtggtgagccgagattgcgccattgcattccagcctgggcaacaggagtgaaactccatctccaaaaaaataaagaaaaaaaggagttgtcattttactctaattatgactgagacttctctacatttataccaagttagctaactttttttgaatattttatcaatgtaatggataaaatatgcttgatctcaaagtggggaaaaactgccaacgtgaatttataaaaactata

SEQ ID NO: 7393 - DNA, 601 bp, Human; identical to SEQ ID NO: 2726

SEQ ID NO: 7394 - DNA, 601 bp, Human; identical to SEQ ID NO: 2727

SEQ ID NO: 7395 - DNA, 601 bp, Human; identical to SEQ ID NO: 2728

SEQ ID NO: 7396 - DNA, 601 bp, Human; identical to SEQ ID NO: 2729

SEQ ID NO: 7397 - DNA, 601 bp, Human; identical to SEQ ID NO: 2730

SEQ ID NO: 7398 - DNA, 601 bp, Human; identical to SEQ ID NO: 2731

SEQ ID NO: 7399 - DNA, 601 bp, Human; identical to SEQ ID NO: 2732

SEQ ID NO: 7400 - DNA, 601 bp, Human; identical to SEQ ID NO: 2733

SEQ ID NO: 7401 - DNA, 601 bp, Human; identical to SEQ ID NO: 2734

SEQ ID NO: 7402 - DNA, 601 bp, Human; identical to SEQ ID NO: 2735

SEQ ID NO: 7403 - DNA, 601 bp, Human; identical to SEQ ID NO: 2736

SEQ ID NO: 7404 - DNA, 601 bp, Human; identical to SEQ ID NO: 2737

SEQ ID NO: 7405 - DNA, 601 bp, Human; identical to SEQ ID NO: 2738

SEQ ID NO: 7406 - DNA, 601 bp, Human; identical to SEQ ID NO: 2739

SEQ ID NO: 7407 - DNA, 601 bp, Human; identical to SEQ ID NO: 2740

SEQ ID NO: 7408 - DNA, 601 bp, Human; identical to SEQ ID NO: 2741

SEQ ID NO: 7409 - DNA, 601 bp, Human
ttcaatgtaatacctggataattgctactgattattcatggcacaaggactcttaagttagcaggtgatgaatgctgcaaggactgaatcctttccgtcaaggcagcgggtccccttctggcccatggtatgtctgtaaatgttatctgggaggcctggaacaggggcttcatgactctgatcattgttctctcttgctgtggctgagctggcatccaagatgcaagtgaagtcctctccgctcttccctctcctctccttaagcagaaggaaagcgtctcttttatagctgcaaggtgtrcagtctggggtgataaagaggggtgatgcccacactcccttggctgccctagatgggaatactgaggtatattgcatgtcccactccagtccaccgtctctgggcagcactaggactcacctaagagttgcagtccctgtggcccagactgcctctcaagtttacttagagacccagagcactttagcttgtggtggtaagatttacaggaactcaagttctgatcactgggattaacaattccctctgtctagggctggtttaaatgttccctccatgagcccgtggcagctgagtttg

SEQ ID NO: 7410 - DNA, 601 bp, Human
ttaagttagcaggtgatgaatgctgcaaggactgaatcctttccgtcaaggcagcgggtccccttctggcccatggtatgtctgtaaatgttatctgggaggcctggaacaggggcttcatgactctgatcattgttctctcttgctgtggctgagctggcatccaagatgcaagtgaagtcctctccgctcttccctctcctctccttaagcagaaggaaagcgtctcttttatagctgcaaggtgtgcagtctggggtgataaagaggggtgatgcccacactcccttggctgccctaratgggaatactgaggtatattgcatgtcccactccagtccaccgtctctgggcagcactaggactcacctaagagttgcagtccctgtggcccagactgcctctcaagtttacttagagacccagagcactttagcttgtggtggtaagatttacaggaactcaagttctgatcactgggattaacaattccctctgtctagggctggtttaaatgttccctccatgagcccgtggcagctgagtttggtccagttttcctttctgttctaacaagtcagcattgagttcagtgcctcac

SEQ ID NO: 7411 - DNA, 601 bp, Human
atagctgcaaggtgtgcagtctggggtgataaagaggggtgatgcccacactcccttggctgccctagatgggaatactgaggtatattgcatgtcccactccagtccaccgtctctgggcagcactaggactcacctaagagttgcagtccctgtggcccagactgcctctcaagtttacttagagacccagagcactttagcttgtggtggtaagatttacaggaactcaagttctgatcactgggattaacaattccctctgtctagggctggtttaaatgttccctccatgagcccrtggcagctgagtttggtccagttttcctttctgttctaacaagtcagcattgagttcagtgcctcacaattgtggtgtcctttctcctccagcaaccagagacactctcagtaccatgccgccactgtcaggggttggcgagagtggcattggtgattgaggactgctttttctatctcattggtgtccttttctgtgatacagatttaaaaccagatactatgagtgatttttggttcttatgaaggtgtttcttctgtgtagatggttgttaacttggtgtccttgtagaggagacaa

SEQ ID NO: 7412 - DNA, 601 bp, Human
cccacactcccttggctgccctagatgggaatactgaggtatattgcatgtcccactccagtccaccgtctctgggcagcactaggactcacctaagagttgcagtccctgtggcccagactgcctctcaagtttacttagagacccagagcactttagcttgtggtggtaagatttacaggaactcaagttctgatcactgggattaacaattccctctgtctagggctggtttaaatgttccctccatgagcccgtggcagctgagtttggtccagttttcctttctgttctaacaagwcagcattgagttcagtgcctcacaattgtggtgtcctttctcctccagcaaccagagacactctcagtaccatgccgccactgtcaggggttggcgagagtggcattggtgattgaggactgctttttctatctcattggtgtccttttctgtgatacagatttaaaaccagatactatgagtgatttttggttcttatgaaggtgtttcttctgtgtagatggttgttaacttggtgtccttgtagaggagacaattggcggattcttctattctgccatcttgttccacattctctcc

SEQ ID NO: 7413 - DNA, 601 bp, Human
cagcactaggactcacctaagagttgcagtccctgtggcccagactgcctctcaagtttacttagagacccagagcactttagcttgtggtggtaagatttacaggaactcaagttctgatcactgggattaacaattccctctgtctagggctggtttaaatgttccctccatgagcccgtggcagctgagtttggtccagttttcctttctgttctaacaagtcagcattgagttcagtgcctcacaattgtggtgtcctttctcctccagcaaccagagacactctcagtaccatgcygccactgtcaggggttggcgagagtggcattggtgattgaggactgctttttctatctcattggtgtccttttctgtgatacagatttaaaaccagatactatgagtgatttttggttcttatgaaggtgtttcttctgtgtagatggttgttaacttggtgtccttgtagaggagacaattggcggattcttctattctgccatcttgttccacattctctccccaagctatacattttacagagttccaggaggggagcaacttattcaaggtcacaaacctggttattgtcagaaac

SEQ ID NO: 7414 - DNA, 601 bp, Human
tgtgaagaccctggcacaagagggaacttggagtatctgaagagtagaaagcagggctagagtgatcctgaatgagagaaattatggcaggtgatgaggttgggtaagtagtcgggggccaagatcaagtaggaaccagcaattcagagtaagtagtatgaattttattctaagaacaatgacaagcagccagacagatcaaaagcaggagagtagcatgagttgattttcatttctgaaacagcagactggccgctgtgcacagaatgatccattccagggtggatcagaagtgcaggtrcagaagcgcaggtaaggcatgaaggcacaggtaacatgatgtcattgaagatggagagatatggatgggttcaaggcaccttaagaggtaaaacccacagatttagtgttggactgaatatggggagaaatatggcaaggtcaaaaaagttaaccaggctttttgacatgcactattgactggatggtgatgctattcagtgaaggaaaatggctctggaggaaaaccagatttaggagtgagatcatgagtttggtcattgctacgttgagtatgaggtgcctttggatggtggaggtc

SEQ ID NO: 7415 - DNA, 601 bp, Human
gggtggatcagaagtgcaggtacagaagcgcaggtaaggcatgaaggcacaggtaacatgatgtcattgaagatggagagatatggatgggttcaaggcaccttaagaggtaaaacccacagatttagtgttggactgaatatggggagaaatatggcaaggtcaaaaaagttaaccaggctttttgacatgcactattgactggatggtgatgctattcagtgaaggaaaatggctctggaggaaaaccagatttaggagtgagatcatgagtttggtcattgctacgttgagtatgagktgcctttggatggtggaggtccagagtaggtcatggcctgtatgggcatggagcttagaggaaggactggagacatgaccttcaaagtcattggccttgaaatgatatttgaagtagtgggtgtgaatgagattgcttaggaaaataatggaaaatagaaggcttagaagtgaagaaaaagacagactgagaaatgaggaggcaaaagtagttgaatttggtgattgacaagttgaagaaggtgaaagaaaagctgttgcctagaatggcttctggattttacatgtgtgtgatctagtg

SEQ ID NO: 7416 - DNA, 601 bp, Human
tttaggagtgagatcatgagtttggtcattgctacgttgagtatgaggtgcctttggatggtggaggtccagagtaggtcatggcctgtatgggcatggagcttagaggaaggactggagacatgaccttcaaagtcattggccttgaaatgatatttgaagtagtgggtgtgaatgagattgcttaggaaaataatggaaaatagaaggcttagaagtgaagaaaaagacagactgagaaatgaggaggcaaaagtagttgaatttggtgattgacaagttgaagaaggtgaaagaaaakctgttgcctagaatggcttctggattttacatgtgtgtgatctagtgggtgatgatacattaacaagctggggataacttttgtttgggacatgctgcatttaaatagtttgtggaatgcacatttattattgccatcataaaagatatgtatttttgcatttttcttagctcctctcttacaacttttccatatcccactccaaatatataggaggaatactggaactaagtaggtgatcgctaaattttggcagacaaatgggagaggaaagaagtagagaaagactgaggggcaggg

SEQ ID NO: 7417 - DNA, 601 bp, Human; identical to SEQ ID NO: 2742

SEQ ID NO: 7418 - DNA, 601 bp, Human; identical to SEQ ID NO: 2743

SEQ ID NO: 7419 - DNA, 601 bp, Human; identical to SEQ ID NO: 2744

SEQ ID NO: 7420 - DNA, 601 bp, Human; identical to SEQ ID NO: 2745

SEQ ID NO: 7421 - DNA, 601 bp, Human; identical to SEQ ID NO: 2746

SEQ ID NO: 7422 - DNA, 601 bp, Human; identical to SEQ ID NO: 2747

SEQ ID NO: 7423 - DNA, 601 bp, Human; identical to SEQ ID NO: 2748

SEQ ID NO: 7424 - DNA, 601 bp, Human; identical to SEQ ID NO: 2749

SEQ ID NO: 7425 - DNA, 601 bp, Human; identical to SEQ ID NO: 2750

SEQ ID NO: 7426 - DNA, 601 bp, Human; identical to SEQ ID NO: 2751

SEQ ID NO: 7427 - DNA, 601 bp, Human; identical to SEQ ID NO: 2752

SEQ ID NO: 7428 - DNA, 601 bp, Human; identical to SEQ ID NO: 2753

SEQ ID NO: 7429 - DNA, 601 bp, Human; identical to SEQ ID NO: 2754

SEQ ID NO: 7430 - DNA, 601 bp, Human; identical to SEQ ID NO: 2755

SEQ ID NO: 7431 - DNA, 601 bp, Human; identical to SEQ ID NO: 2756

SEQ ID NO: 7432 - DNA, 601 bp, Human; identical to SEQ ID NO: 2757

SEQ ID NO: 7433 - DNA, 601 bp, Human; identical to SEQ ID NO: 2758

SEQ ID NO: 7434 - DNA, 601 bp, Human; identical to SEQ ID NO: 2759

SEQ ID NO: 7435 - DNA, 601 bp, Human; identical to SEQ ID NO: 2760

SEQ ID NO: 7436 - DNA, 601 bp, Human; identical to SEQ ID NO: 2761

SEQ ID NO: 7437 - DNA, 601 bp, Human; identical to SEQ ID NO: 2762

SEQ ID NO: 7438 - DNA, 601 bp, Human; identical to SEQ ID NO: 2763

SEQ ID NO: 7439 - DNA, 601 bp, Human; identical to SEQ ID NO: 2764

SEQ ID NO: 7440 - DNA, 601 bp, Human; identical to SEQ ID NO: 2765

SEQ ID NO: 7441 - DNA, 601 bp, Human; identical to SEQ ID NO: 2766

SEQ ID NO: 7442 - DNA, 601 bp, Human; identical to SEQ ID NO: 2767

SEQ ID NO: 7443 - DNA, 601 bp, Human; identical to SEQ ID NO: 2768

SEQ ID NO: 7444 - DNA, 601 bp, Human; identical to SEQ ID NO: 2769

SEQ ID NO: 7445 - DNA, 601 bp, Human; identical to SEQ ID NO: 2770

SEQ ID NO: 7446 - DNA, 601 bp, Human; identical to SEQ ID NO: 2771

SEQ ID NO: 7447 - DNA, 601 bp, Human; identical to SEQ ID NO: 2772

SEQ ID NO: 7448 - DNA, 601 bp, Human; identical to SEQ ID NO: 2773

SEQ ID NO: 7449 - DNA, 601 bp, Human; identical to SEQ ID NO: 2774

SEQ ID NO: 7450 - DNA, 601 bp, Human; identical to SEQ ID NO: 2775

SEQ ID NO: 7451 - DNA, 601 bp, Human; identical to SEQ ID NO: 2776

SEQ ID NO: 7452 - DNA, 601 bp, Human; identical to SEQ ID NO: 2777

SEQ ID NO: 7453 - DNA, 601 bp, Human; identical to SEQ ID NO: 2778

SEQ ID NO: 7454 - DNA, 601 bp, Human; identical to SEQ ID NO: 2779

SEQ ID NO: 7455 - DNA, 601 bp, Human; identical to SEQ ID NO: 2780

SEQ ID NO: 7456 - DNA, 601 bp, Human; identical to SEQ ID NO: 2781

SEQ ID NO: 7457 - DNA, 601 bp, Human; identical to SEQ ID NO: 2782

SEQ ID NO: 7458 - DNA, 601 bp, Human; identical to SEQ ID NO: 2783

SEQ ID NO: 7459 - DNA, 601 bp, Human; identical to SEQ ID NO: 2784

SEQ ID NO: 7460 - DNA, 601 bp, Human; identical to SEQ ID NO: 2785

SEQ ID NO: 7461 - DNA, 601 bp, Human; identical to SEQ ID NO: 2786

SEQ ID NO: 7462 - DNA, 601 bp, Human; identical to SEQ ID NO: 2787

SEQ ID NO: 7463 - DNA, 601 bp, Human; identical to SEQ ID NO: 2788

SEQ ID NO: 7464 - DNA, 601 bp, Human; identical to SEQ ID NO: 2789

SEQ ID NO: 7465 - DNA, 601 bp, Human; identical to SEQ ID NO: 2790

SEQ ID NO: 7466 - DNA, 601 bp, Human; identical to SEQ ID NO: 2791

SEQ ID NO: 7467 - DNA, 601 bp, Human; identical to SEQ ID NO: 2792

SEQ ID NO: 7468 - DNA, 601 bp, Human; identical to SEQ ID NO: 2793

SEQ ID NO: 7469 - DNA, 601 bp, Human; identical to SEQ ID NO: 2794

SEQ ID NO: 7470 - DNA, 601 bp, Human; identical to SEQ ID NO: 2795

SEQ ID NO: 7471 - DNA, 601 bp, Human; identical to SEQ ID NO: 2796

SEQ ID NO: 7472 - DNA, 601 bp, Human; identical to SEQ ID NO: 2797

SEQ ID NO: 7473 - DNA, 601 bp, Human; identical to SEQ ID NO: 2798

SEQ ID NO: 7474 - DNA, 601 bp, Human; identical to SEQ ID NO: 2799

SEQ ID NO: 7475 - DNA, 601 bp, Human; identical to SEQ ID NO: 2800

SEQ ID NO: 7476 - DNA, 601 bp, Human; identical to SEQ ID NO: 2801

SEQ ID NO: 7477 - DNA, 601 bp, Human; identical to SEQ ID NO: 2802

SEQ ID NO: 7478 - DNA, 601 bp, Human; identical to SEQ ID NO: 2803

SEQ ID NO: 7479 - DNA, 601 bp, Human; identical to SEQ ID NO: 2804

SEQ ID NO: 7480 - DNA, 601 bp, Human; identical to SEQ ID NO: 2805

SEQ ID NO: 7481 - DNA, 601 bp, Human; identical to SEQ ID NO: 2806

SEQ ID NO: 7482 - DNA, 601 bp, Human; identical to SEQ ID NO: 2807

SEQ ID NO: 7483 - DNA, 601 bp, Human; identical to SEQ ID NO: 2808

SEQ ID NO: 7484 - DNA, 601 bp, Human; identical to SEQ ID NO: 2809

SEQ ID NO: 7485 - DNA, 601 bp, Human; identical to SEQ ID NO: 2810

SEQ ID NO: 7486 - DNA, 601 bp, Human; identical to SEQ ID NO: 2811

SEQ ID NO: 7487 - DNA, 601 bp, Human; identical to SEQ ID NO: 2812

SEQ ID NO: 7488 - DNA, 601 bp, Human; identical to SEQ ID NO: 2813

SEQ ID NO: 7489 - DNA, 601 bp, Human; identical to SEQ ID NO: 2814

SEQ ID NO: 7490 - DNA, 601 bp, Human; identical to SEQ ID NO: 2815

SEQ ID NO: 7491 - DNA, 601 bp, Human; identical to SEQ ID NO: 2816

SEQ ID NO: 7492 - DNA, 601 bp, Human; identical to SEQ ID NO: 2817

SEQ ID NO: 7493 - DNA, 601 bp, Human; identical to SEQ ID NO: 2818

SEQ ID NO: 7494 - DNA, 601 bp, Human; identical to SEQ ID NO: 2819

SEQ ID NO: 7495 - DNA, 601 bp, Human; identical to SEQ ID NO: 2820

SEQ ID NO: 7496 - DNA, 601 bp, Human; identical to SEQ ID NO: 2821

SEQ ID NO: 7497 - DNA, 601 bp, Human; identical to SEQ ID NO: 2695

SEQ ID NO: 7498 - DNA, 601 bp, Human; identical to SEQ ID NO: 2696

SEQ ID NO: 7499 - DNA, 601 bp, Human; identical to SEQ ID NO: 2697

SEQ ID NO: 7500 - DNA, 601 bp, Human; identical to SEQ ID NO: 2698

SEQ ID NO: 7501 - DNA, 601 bp, Human; identical to SEQ ID NO: 2699

SEQ ID NO: 7502 - DNA, 601 bp, Human; identical to SEQ ID NO: 2700

SEQ ID NO: 7503 - DNA, 601 bp, Human; identical to SEQ ID NO: 2701

SEQ ID NO: 7504 - DNA, 601 bp, Human; identical to SEQ ID NO: 2702

SEQ ID NO: 7505 - DNA, 601 bp, Human; identical to SEQ ID NO: 2703

SEQ ID NO: 7506 - DNA, 601 bp, Human; identical to SEQ ID NO: 2704

SEQ ID NO: 7507 - DNA, 601 bp, Human
atctagacaaaatatctatgttcacaggatcttgttaatttcctaggagcccctatgatgtagcctgttgtgtcaagatgattttagaagttaagccccagacaaatgcatcctgtgagtattccgcatcacataagcaagacctacttcttgggagcactggctctatttcttgccccagtctcagctgccaaagtgatgcacaaagtccagcggtaacctggtacaaggtaagagtgaattctctaaaattaatataagagcattgtttttatggtatcttcttcatgggcttttcatrgaaaagcgtgtttgagaatctgaggtatacagcttctcaaaaactggccctgtgcctctgcaggagatctgactttctaaaataatcatgttccctgggaagccacagagcttgatattctaattattagaggcatccttttgatcaacaccagagaaacttctaaaattcaagtatattacacatgaggttagacataaacctactaacatctgctaatgtaggaagataggttcactcattttcactgtcttaggaaagcaacaggcattgcaaaggggaagggaggactcaacacat

SEQ ID NO: 7508 - DNA, 601 bp, Human
caaagtatccgtcatccaggatggcagctgtcttgttgtcttggtgggctgttctcaggcctgtaaagcagtcttgtccccgttatttcagatgaaaatgtgtttggcttttcaatgatcatacacctgaagtgaaagctatgaatttttacttttcaggtgagcacaagttgcataatagtagccagctttctgcaaatattgcttttataaactaaaccctaaaactgtatgacattcacaaaaggaagctttgtttcacttccctggggctttgactgcaaacgtcaacatgtgtttratggtgaacaggcagccaccttaagaataggtgaacaatggctgttatgaaaattgtacctctgatacagatttggacaggtcctggttttgtgaattacacatatgtgtgtgtgcactcacacatacacatgcatataaaggcacatagtaacctggaaatcacagaccttatggcagtagtacatcactaaaagtgatggcattaggcaggaaaaaacacctaatgcctttttccttcatgctaacccccaggttctcaggtggtgggtaagtcatacctacgacccatctctgaata

SEQ ID NO: 7509 - DNA, 601 bp, Human
ggcagccaccttaagaataggtgaacaatggctgttatgaaaattgtacctctgatacagatttggacaggtcctggttttgtgaattacacatatgtgtgtgtgcactcacacatacacatgcatataaaggcacatagtaacctggaaatcacagaccttatggcagtagtacatcactaaaagtgatggcattaggcaggaaaaaacacctaatgcctttttccttcatgctaacccccaggttctcaggtggtgggtaagtcatacctacgacccatctctgaataggtgaagctgrcactggctgagagaatgaaaacatggctttactgaattcaaataaaactgctgaccagggatacacccaccagatatacagagtatacaactgaaataaatccctgggcttggagtctctggagcattccacaatatttttaattggcgaattaagaacaggcttgcagattgtttaaattttttttcaacttctttattttaaaattatttttaattaacaaatcataattgtatacatttacaatagattaaatatatacaatacatttaatggtcaatagattttaaaaaaagatgc

SEQ ID NO: 7510 - DNA, 601 bp, Human
cacaatggggaaaggattacctctccaataagtggtgttaggaaaactggttatctacagggagaagaatgaaattgtatctcataccacatgcaaaaaaaagtattgatgtgatgttttgatatatgtatacaatgtggagtgattaactcaagctaattaacacatccatcaccttgcttactttttttgtggacagacatttgaaacttactctcttagttattttgaaatgtgcaatacaatattattggctatagttatcttgctgtgaaatatgcctgaaaacttaactcctccyatctatctgaaactttgtactctttgaccagtatctccccattcaccctcttctccccaccaatcaagcctccataatcatcattctattctctacttctatgagttcaactttttaaggttctatatatgagtgagctcttgcagcatttgtctttctgtgcccggcttatttcacttagcatagcttccaagtttattcgtgttctcccacatgattgaatttccttttgtaaaggctgaatagtatttcgttgcatacatgtaccacattttctttgtccattcctctgttgatgga

SEQ ID NO: 7511 - DNA, 601 bp, Human
ggttctatatatgagtgagctcttgcagcatttgtctttctgtgcccggcttatttcacttagcatagcttccaagtttattcgtgttctcccacatgattgaatttccttttgtaaaggctgaatagtatttcgttgcatacatgtaccacattttctttgtccattcctctgttgatggacactaaggttgattccatatcttggctattgtgaatagtgctgcagtaagcataggagcgtagttaaccctttgccatactgatttcaatctctttggatatgtacccaaaagtgggawtgctgaatcatatggtagctctatttttagtttttctgatgagacttcatagagtttctcttaatggctgtactaatttacatttctaccaacaatgtacaacagattaatttttttgataaaagccactctaacaagtgtgaggtgatatgtcattgtggtttcaatttgtatttctatgatgattagtgatactcagcattttttcatatagttgttggccatttgcatcctttcttttgagaaatatcttttcaggtctcttgcctatttttaaaatgggctatttgttttcttgct

SEQ ID NO: 7512 - DNA, 601 bp, Human
tatttcgttgcatacatgtaccacattttctttgtccattcctctgttgatggacactaaggttgattccatatcttggctattgtgaatagtgctgcagtaagcataggagcgtagttaaccctttgccatactgatttcaatctctttggatatgtacccaaaagtgggattgctgaatcatatggtagctctatttttagtttttctgatgagacttcatagagtttctcttaatggctgtactaatttacatttctaccaacaatgtacaacagattaatttttttgataaaagccrctctaacaagtgtgaggtgatatgtcattgtggtttcaatttgtatttctatgatgattagtgatactcagcattttttcatatagttgttggccatttgcatcctttcttttgagaaatatcttttcaggtctcttgcctatttttaaaatgggctatttgttttcttgctaatgcagtgtttgagttccttatatattcttcacattaactccttatcagatatatagcttgtaaatattttccccatttggtgggttgtttcctttgctacacagaagctttttagttttatgctat

SEQ ID NO: 7513 - DNA, 601 bp, Human
tctcttttttcttagtctagctaagagtttgttaattttgtttttagttttttcagtaaaccaactcttagttttattcattttttcctattgtttttctaatctctgtttcatttatttctgcttttatctttgttacttcctttcttctgcaaactttgggcttcatttattaccctttttctaacatctttctgtgtatcattagattgcttatttgaaatctttcctgtgtttcaatgcagacattcattgctataaatttccctcaggactgctttcgctgcatcccacatgtttkagtacactgtgttttaacttgtttgtctcaatttattttttaacttcctttttatttcttctttatcccattggttgtttaggagcactttgtttcatttctgcatatgtgcatattttccaagatattttctgtttttagatttctacctttatgcctttgtagcccaaaatacacttgatatgatttcaattttcttaaagttgttaagacttatcttgtagctgaacgtatccttcctggaaaatgttctatgtgtacttgagaaggatgtgtattctgctgctgttggatagaatg

SEQ ID NO: 7514 - DNA, 601 bp, Human
tgcagactgtcttcccaaatagcctgcaactttgcctgatcagaggcagtcacagagcaatacccttgtgtcttccattcacccacaacatgaaggaattgcttaattaactaaaagggcacccaaatgccctacatctggccgagaaatactgttgttagaatgtgtagttgggcaggacaacaggctaggccctgaggcaaagttagttatctgggattgctgctcagcaatttgggatgggcagggggagaaactaggctacaaagatgtgtgtgggcttgatcttacccctgggccrgggatagccttaggcagggcattgaggcttgattgggttgccacgcaccttctggacctgggtggggccagctgctccttctgcagataactgctgacctgcctttgcctcctggcctggggaaggctgcaggaaggtgctggagcctggctgggtcaccatgcttggagattattaattaaaatatttaatgactgaaaaagtcagaattaaagtgagttatttattatttatgctactaactttttctatatatttttctaatttctaaaaatgtaatgaaaaaatagccttggcata

SEQ ID NO: 7515 - DNA, 601 bp, Human
gcaccttgaataacatttccattggtggtttaagacaatctcactcatgccacattctcttgccacacttctgacatggctgctgggttgattttaagccctatgttgcatggaaggtttttgtttgtttgttttagagataggatcttattctgccacctaggttggagtacagtggtgtaatcacagctccctgcagtcttgaacttctgggcccaagtgatcctccagccttagcatctcaagtagttgggactacaggcacataccactgcacccagctaattttaaaaattttttrtagagaaggggtttcactatgttgctcaggctggtttcaaattcgtggtttcaaccaatcctcctgccttggccttccaaagtgctgggattacaggtgtgagccatcatgccaaccacaaagaagtttgtttgttttttgagatggaatctctctctttgtcgcctaggctagagcgcatctagctcagtgcactgagctagagacttggctcactgcaacctccacctcccaggttcaagctattctcatgcctcagcctcccaagtagctgggattacaggtgtgcgccaccacacc

SEQ ID NO: 7516 - DNA, 601 bp, Human
tctcactatgaacatttcagaactctgaagatctggacagctttctaacacctgttcaaaacaatcatctgtatgctgtctaaccagcactgaaacagaggaagaatttccttacttgttcagaacagaatattgccacagccccactattgttttagctttgggacagcctcattatatggttgatttattctgagttggcaggcaagtctttccacaaaaactgaaatcaagcaagttctctctatttttgtttgtagagtagaatttgtaacttatgttcatgattttatatttattyctgttaaataatttgttgtttttagttcattctacatgtcaagaggttggaattctgattttgaatgccgacatattagccatcacacgcaggtttgtgaggcatgtagatgagatcaacatggtatgttctccctcaagcccctgctaaaactacgggcgaggctaacaccagggacagagtgctctgctgttaactccagtttgatccttctagttacatatgatccattcatccacaacgcaagggtgttgcttaattaactaaaagggcactcgaatgccctatatctgatcattc

SEQ ID NO: 7517 - DNA, 601 bp, Human
gaacatttcagaactctgaagatctggacagctttctaacacctgttcaaaacaatcatctgtatgctgtctaaccagcactgaaacagaggaagaatttccttacttgttcagaacagaatattgccacagccccactattgttttagctttgggacagcctcattatatggttgatttattctgagttggcaggcaagtctttccacaaaaactgaaatcaagcaagttctctctatttttgtttgtagagtagaatttgtaacttatgttcatgattttatatttatttctgttaaaaaatttgttgtttttagttcattctacatgtcaagaggttggaattctgattttgaatgccgacatattagccatcacacgcaggtttgtgaggcatgtagatgagatcaacatggtatgttctccctcaagcccctgctaaaactacgggcgaggctaacaccagggacagagtgctctgctgttaactccagtttgatccttctagttacatatgatccattcatccacaacgcaagggtgttgcttaattaactaaaagggcactcgaatgccctatatctgatcattcagctcacaa

SEQ ID NO: 7518 - DNA, 601 bp, Human
attatatggttgatttattctgagttggcaggcaagtctttccacaaaaactgaaatcaagcaagttctctctatttttgtttgtagagtagaatttgtaacttatgttcatgattttatatttatttctgttaaataatttgttgtttttagttcattctacatgtcaagaggttggaattctgattttgaatgccgacatattagccatcacacgcaggtttgtgaggcatgtagatgagatcaacatggtatgttctccctcaagcccctgctaaaactacgggcgaggctaacaccagggacagagtgctctgctgttaactccagtttgatccttctagttacatatgatccattcatccacaacgcaagggtgttgcttaattaactaaaagggcactcgaatgccctatatctgatcattcagctcacaatgtacctttggtttaacagagagatcatgagaatatttttcaagtgactcacaatagtgaagatactctgtgtctgccatactcctgtgaacctccagtctattcagttgtgggcaacaatgagattgccttgatatgattgttgttagcaaatgcaagctggc

SEQ ID NO: 7519 - DNA, 601 bp, Human
ttatatttatttctgttaaataatttgttgtttttagttcattctacatgtcaagaggttggaattctgattttgaatgccgacatattagccatcacacgcaggtttgtgaggcatgtagatgagatcaacatggtatgttctccctcaagcccctgctaaaactacgggcgaggctaacaccagggacagagtgctctgctgttaactccagtttgatccttctagttacatatgatccattcatccacaacgcaagggtgttgcttaattaactaaaagggcactcgaatgccctatrtctgatcattcagctcacaatgtacctttggtttaacagagagatcatgagaatatttttcaagtgactcacaatagtgaagatactctgtgtctgccatactcctgtgaacctccagtctattcagttgtgggcaacaatgagattgccttgatatgattgttgttagcaaatgcaagctggctgatattaaccatcacttccttttctaagggttcataaaccatctgttaaataattaattcaagactttcactagaaattgacatctagcccattatcaataatttccataatata

SEQ ID NO: 7520 - DNA, 601 bp, Human
gtttaacagagagatcatgagaatatttttcaagtgactcacaatagtgaagatactctgtgtctgccatactcctgtgaacctccagtctattcagttgtgggcaacaatgagattgccttgatatgattgttgttagcaaatgcaagctggctgatattaaccatcacttccttttctaagggttcataaaccatctgttaaataattaattcaagactttcactagaaattgacatctagcccattatcaataatttccataatatactccattcccattaaaagataaatattagtaaaaaaaaaatctatcaatagaatgttgttagttgataactggggcaagagactgcaactacacttaacgggaaagagcaacatagacaacagaaacagaaaagcaaagggtatgttcagtgtatggtcacactgagtggctcactgtggtgggagctgagagttcttaagtggtttaattaggactagaatggaaataaaggttgtgtggttctcatgatggttatggggaccttgctgatgtgtttgaactttatgagtgtgagtcctgatccaggacaggacagaaagaagtggaaac

SEQ ID NO: 7521 - DNA, 601 bp, Human
gtttcccatcatccttggcataaattgcttctccctaatttcttttctttgatatttcctctaagttccatttcataaagtcttaatgatacatactaagcctcacttacctatttatgggtaaaaaagatacattattccccatcctcccccttggcttaggtgaggtcttagttacggctctgtgtcctcccaccattacgttctcatgcgatttatgacacgcctctcccctgaattctgatctttatatgttatcactgcgtcctctgaagttttatctttgaatttccccctatgytttaaaacttccttttgaaaagttcctgattcttgagatcatctggtatatatttagccttgtataccactacctctttgccttgttttgcttcctgcccacagctgcacttctctggccactctgcccccacccttagtctcctttccagcctgctggaaattccttcttggaccacaggaaacacacgagggatgtggcgtgggggaatcccagcttctactagtaggcaggcaaagtggaagggaaattcctcaatcagaaaataaaactcagaaccagaaaaaaatgaggttgatt

SEQ ID NO: 7522 - DNA, 601 bp, Human
tccttggcataaattgcttctccctaatttcttttctttgatatttcctctaagttccatttcataaagtcttaatgatacatactaagcctcacttacctatttatgggtaaaaaagatacattattccccatcctcccccttggcttaggtgaggtcttagttacggctctgtgtcctcccaccattacgttctcatgcgatttatgacacgcctctcccctgaattctgatctttatatgttatcactgcgtcctctgaagttttatctttgaatttccccctatgttttaaaacttmcttttgaaaagttcctgattcttgagatcatctggtatatatttagccttgtataccactacctctttgccttgttttgcttcctgcccacagctgcacttctctggccactctgcccccacccttagtctcctttccagcctgctggaaattccttcttggaccacaggaaacacacgagggatgtggcgtgggggaatcccagcttctactagtaggcaggcaaagtggaagggaaattcctcaatcagaaaataaaactcagaaccagaaaaaaatgaggttgattctcagtgctct

SEQ ID NO: 7523 - DNA, 601 bp, Human
tcccaccattacgttctcatgcgatttatgacacgcctctcccctgaattctgatctttatatgttatcactgcgtcctctgaagttttatctttgaatttccccctatgttttaaaacttccttttgaaaagttcctgattcttgagatcatctggtatatatttagccttgtataccactacctctttgccttgttttgcttcctgcccacagctgcacttctctggccactctgcccccacccttagtctcctttccagcctgctggaaattccttcttggaccacaggaaacacacsagggatgtggcgtgggggaatcccagcttctactagtaggcaggcaaagtggaagggaaattcctcaatcagaaaataaaactcagaaccagaaaaaaatgaggttgattctcagtgctctcacttaccagctttgtcagagagagaaaaaaaagccactcacgttccagaacctctgtttatataagtttttatttataagtatgtatctgtttatatacgtaaatatatacaatatatgttatatatatgtgtgtgtatgtatatatatgtgtgtgtgtgtgtatatatatatatgta

SEQ ID NO: 7524 - DNA, 601 bp, Human; identical to SEQ ID NO: 2705

SEQ ID NO: 7525 - DNA, 601 bp, Human; identical to SEQ ID NO: 2706

SEQ ID NO: 7526 - DNA, 601 bp, Human; identical to SEQ ID NO: 2707

SEQ ID NO: 7527 - DNA, 601 bp, Human; identical to SEQ ID NO: 2708

SEQ ID NO: 7528 - DNA, 601 bp, Human; identical to SEQ ID NO: 2709

SEQ ID NO: 7529 - DNA, 601 bp, Human; identical to SEQ ID NO: 2710

SEQ ID NO: 7530 - DNA, 601 bp, Human; identical to SEQ ID NO: 2711

SEQ ID NO: 7531 - DNA, 601 bp, Human; identical to SEQ ID NO: 2712

SEQ ID NO: 7532 - DNA, 601 bp, Human; identical to SEQ ID NO: 2713

SEQ ID NO: 7533 - DNA, 601 bp, Human; identical to SEQ ID NO: 2714

SEQ ID NO: 7534 - DNA, 601 bp, Human; identical to SEQ ID NO: 2715

SEQ ID NO: 7535 - DNA, 601 bp, Human; identical to SEQ ID NO: 2716

SEQ ID NO: 7536 - DNA, 601 bp, Human; identical to SEQ ID NO: 2717

SEQ ID NO: 7537 - DNA, 601 bp, Human; identical to SEQ ID NO: 2718

SEQ ID NO: 7538 - DNA, 601 bp, Human; identical to SEQ ID NO: 2719

SEQ ID NO: 7539 - DNA, 601 bp, Human; identical to SEQ ID NO: 2720

SEQ ID NO: 7540 - DNA, 601 bp, Human; identical to SEQ ID NO: 2721

SEQ ID NO: 7541 - DNA, 601 bp, Human; identical to SEQ ID NO: 2722

SEQ ID NO: 7542 - DNA, 601 bp, Human; identical to SEQ ID NO: 2723

SEQ ID NO: 7543 - DNA, 601 bp, Human; identical to SEQ ID NO: 2724

SEQ ID NO: 7544 - DNA, 601 bp, Human; identical to SEQ ID NO: 2725

SEQ ID NO: 7545 - DNA, 601 bp, Human; identical to SEQ ID NO: 2995

SEQ ID NO: 7546 - DNA, 601 bp, Human
aatctccgcctcctgggttcaagggattctcctgcctcagcctcacgagtagctaggactacagatgcgtgccatcacgcccggctaattttttgtattttttttagtaaagatggggtttcaccatattggccaggctggttgcgaactcctgaccttgtgatccacccatctcggcctcccctgcaaaaatgtaaagcgctttaaagtgctgctttactatgtgtccagtatttctaccagcctctttgcttttcccacatagttaagttttttcaatgacaagtcactataggtttartgcaaaatgaaagaaaattcagataaaagcaggcattataaatatgacaatagttttcccaagaagcttaccgaaatttccctgcccattatcagagcggtggtaacaaggatgaaactgaacacctttgccatgttcccccttgaaaaaactgcaagaacaaaaagaattttataaatgtatcaaccttgaatttttcatgagaccagagttcagacttcagtagctccaggaagtcggatgcagccgcaggccatccctaatcttagagtcgccgaggaaattctcccagactttccc

SEQ ID NO: 7547 - DNA, 601 bp, Human
ctccctgcaacctctgcctctctggttcaagcgattcttgtgcttcatcctggcaagtagctgggactatacaggttgtgtgccataacacccagctaatttttgtatttttagtagagatggggttttgccatgttgcccagtctggtctcaaacttctggcttcaagcgatccacccacctcggcccctcaaagtgctgggattacaggcgtgagccactgcaccaggcctctctaggattacttcttatttgttcttgttactctatccctaacactcagatttatcccttctgagakagttatttgcttagcaccttgagtcacataggctaaaaaatgaacagcaagaacattttatggtgtctgggtcctgagttgttttacaacagtgggggatcggttgtgatattgttaaacatagtgcactatgcaattttaaaataattgaagacatcacaggtcaagtatgcccaatctttatgagattgcatacgcatatttagtaagcttatttaaaacctaggagttttctttctccaagaactttgaatgaatgttttgtcttttttattcacaaatgaaggacaacacaagttc

SEQ ID NO: 7548 - DNA, 601 bp, Human
atatgtaatatattaaatatataatatatatcatatgtaatatattaaatatataatatatatcatatgtaatatattaaatatataatatatatcatatgtaatatattaaatatataatatatatcatatgtaatatattaaataatatataatatattaaataatatataatatatatcatatataatatattaaataatatataatatatatcatatataatatattaaataatatataatatatatcatatataatatattaaataatatataatatatatcatatataatatatyaaataacatataataatatataatatattaaataatatataatataataataatatataatatataaaataatatacaatataataataatatataatatatattacaaaatatataatatgaatatatatgaatataaatgaatagatattatataatatataaatataaataatatataatatattaaatatatttatatataatataatgtaatataattgtatttattatattatagtctactttatataatatattatatttatacataatatacgtatatataaaattacataa

SEQ ID NO: 7549 - DNA, 601 bp, Human
ttaaataatatataatatatatcatatgtaatatattaaatatataatatatatcatatgtaatatattaaatatataatatatatcatatgtaatatattaaatatataatatatatcatatgtaatatattaaatatataatatatatcatatgtaatatattaaataatatataatatattaaataatatataatatatatcatatataatatattaaataatatataatatatatcatatataatatattaaataatatataatatatatcatatataatatattaaataatatatmatatatatcatatataatatattaaataacatataataatatataatatattaaataatatataatataataataatatataatatataaaataatatacaatataataataatatataatatatattacaaaatatataatatgaatatatatgaatataaatgaatagatattatataatatataaatataaataatatataatatattaaatatatttatatataatataatgtaatataattgtatttattatattatagtctactttatataatatattatatttatacataata

SEQ ID NO: 7550 - DNA, 601 bp, Human
tatataatatatctcatatataatatattaaataatatataatatatatcatatgtaatatattaaatatataatatatatcatatgtaatatattaaatatataatatatatcatatgtaatatattaaatatataatatatatcatatgtaatatattaaatatataatatatatcatatgtaatatattaaataatatataatatattaaataatatataatatatatcatatataatatattaaataatatataatatatatcatatataatatattaaataatatataatatatakcatatataatatattaaataatatataatatatatcatatataatatattaaataacatataataatatataatatattaaataatatataatataataataatatataatatataaaataatatacaatataataataatatataatatatattacaaaatatataatatgaatatatatgaatataaatgaatagatattatataatatataaatataaataatatataatatattaaatatatttatatataatataatgtaatataattgtatttattatattatagtctacttta

SEQ ID NO: 7551 - DNA, 601 bp, Human
cttaaaaaaaacaagttatgagtagtctgttaataacagtatatttaggtggaacttacagttttatcagacggaatagtaaaatttatctcacccatgaagctaaaatgaaagcagaaatgttaacaccaaagttactacaggttatcctgacttagagcatgataaatcattctggacatctgaaaatgaacccaaaatagtaatcttgtaaaaatctttattattatactttaagttctagggtacatgtgcacaacatgcaggtttgttacatatgtatatgtgtgccatgttggtrtgctgcacccataatcttgtcaaaatcttataatctcttagccttattagattttttactaacccactgaagtttctaaaagtccatacattcttagatgtttttgctaaaaactgcaagcttctgctattcttttcatcccttaattcttttttgctgtggtatttctttgaacactgaagcaaacgtagctacccctttgtcaccaaaaagtgatatctctttctttctttctttctttctttctttcttctttctttctttctttctttcctttctttctttctttctttctttctt

SEQ ID NO: 7552 - DNA, 601 bp, Human; identical to SEQ ID NO: 2996

SEQ ID NO: 7553 - DNA, 601 bp, Human; identical to SEQ ID NO: 2997

SEQ ID NO: 7554 - DNA, 601 bp, Human; identical to SEQ ID NO: 2998

SEQ ID NO: 7555 - DNA, 601 bp, Human; identical to SEQ ID NO: 2999

SEQ ID NO: 7556 - DNA, 601 bp, Human; identical to SEQ ID NO: 3000

SEQ ID NO: 7557 - DNA, 601 bp, Human; identical to SEQ ID NO: 3001

SEQ ID NO: 7558 - DNA, 601 bp, Human; identical to SEQ ID NO: 3002

SEQ ID NO: 7559 - DNA, 601 bp, Human; identical to SEQ ID NO: 3003

SEQ ID NO: 7560 - DNA, 601 bp, Human; identical to SEQ ID NO: 3004

SEQ ID NO: 7561 - DNA, 601 bp, Human; identical to SEQ ID NO: 3005

SEQ ID NO: 7562 - DNA, 601 bp, Human; identical to SEQ ID NO: 3006

SEQ ID NO: 7563 - DNA, 601 bp, Human; identical to SEQ ID NO: 3007

SEQ ID NO: 7564 - DNA, 601 bp, Human; identical to SEQ ID NO: 3008

SEQ ID NO: 7565 - DNA, 601 bp, Human; identical to SEQ ID NO: 3009

SEQ ID NO: 7566 - DNA, 601 bp, Human; identical to SEQ ID NO: 3010

SEQ ID NO: 7567 - DNA, 601 bp, Human; identical to SEQ ID NO: 3011

SEQ ID NO: 7568 - DNA, 601 bp, Human; identical to SEQ ID NO: 3012

SEQ ID NO: 7569 - DNA, 601 bp, Human; identical to SEQ ID NO: 3013

SEQ ID NO: 7570 - DNA, 601 bp, Human; identical to SEQ ID NO: 3694

SEQ ID NO: 7571 - DNA, 601 bp, Human; identical to SEQ ID NO: 3695

SEQ ID NO: 7572 - DNA, 601 bp, Human; identical to SEQ ID NO: 3696

SEQ ID NO: 7573 - DNA, 601 bp, Human; identical to SEQ ID NO: 3697

SEQ ID NO: 7574 - DNA, 601 bp, Human; identical to SEQ ID NO: 3698

SEQ ID NO: 7575 - DNA, 601 bp, Human; identical to SEQ ID NO: 3699

SEQ ID NO: 7576 - DNA, 601 bp, Human; identical to SEQ ID NO: 3700

SEQ ID NO: 7577 - DNA, 601 bp, Human; identical to SEQ ID NO: 3701

SEQ ID NO: 7578 - DNA, 601 bp, Human; identical to SEQ ID NO: 3702

SEQ ID NO: 7579 - DNA, 601 bp, Human; identical to SEQ ID NO: 3703

SEQ ID NO: 7580 - DNA, 601 bp, Human; identical to SEQ ID NO: 3704

SEQ ID NO: 7581 - DNA, 601 bp, Human; identical to SEQ ID NO: 3705

SEQ ID NO: 7582 - DNA, 601 bp, Human; identical to SEQ ID NO: 3706

SEQ ID NO: 7583 - DNA, 601 bp, Human; identical to SEQ ID NO: 3707

SEQ ID NO: 7584 - DNA, 601 bp, Human; identical to SEQ ID NO: 3708

SEQ ID NO: 7585 - DNA, 601 bp, Human; identical to SEQ ID NO: 3709

SEQ ID NO: 7586 - DNA, 601 bp, Human; identical to SEQ ID NO: 3710

SEQ ID NO: 7587 - DNA, 601 bp, Human; identical to SEQ ID NO: 3711

SEQ ID NO: 7588 - DNA, 601 bp, Human; identical to SEQ ID NO: 3712

SEQ ID NO: 7589 - DNA, 601 bp, Human; identical to SEQ ID NO: 3713

SEQ ID NO: 7590 - DNA, 601 bp, Human; identical to SEQ ID NO: 3714

SEQ ID NO: 7591 - DNA, 601 bp, Human; identical to SEQ ID NO: 3715

SEQ ID NO: 7592 - DNA, 601 bp, Human; identical to SEQ ID NO: 3716

SEQ ID NO: 7593 - DNA, 601 bp, Human; identical to SEQ ID NO: 3717

SEQ ID NO: 7594 - DNA, 601 bp, Human; identical to SEQ ID NO: 3718

SEQ ID NO: 7595 - DNA, 601 bp, Human; identical to SEQ ID NO: 3719

SEQ ID NO: 7596 - DNA, 601 bp, Human; identical to SEQ ID NO: 3720

SEQ ID NO: 7597 - DNA, 601 bp, Human; identical to SEQ ID NO: 3721

SEQ ID NO: 7598 - DNA, 601 bp, Human; identical to SEQ ID NO: 3722

SEQ ID NO: 7599 - DNA, 601 bp, Human; identical to SEQ ID NO: 3723

SEQ ID NO: 7600 - DNA, 601 bp, Human; identical to SEQ ID NO: 3724

SEQ ID NO: 7601 - DNA, 601 bp, Human; identical to SEQ ID NO: 3725

SEQ ID NO: 7602 - DNA, 601 bp, Human; identical to SEQ ID NO: 3726

SEQ ID NO: 7603 - DNA, 601 bp, Human; identical to SEQ ID NO: 3727

SEQ ID NO: 7604 - DNA, 601 bp, Human; identical to SEQ ID NO: 3728

SEQ ID NO: 7605 - DNA, 601 bp, Human; identical to SEQ ID NO: 3729

SEQ ID NO: 7606 - DNA, 601 bp, Human; identical to SEQ ID NO: 3730

SEQ ID NO: 7607 - DNA, 601 bp, Human; identical to SEQ ID NO: 3731

SEQ ID NO: 7608 - DNA, 601 bp, Human; identical to SEQ ID NO: 3732

SEQ ID NO: 7609 - DNA, 601 bp, Human; identical to SEQ ID NO: 3733

SEQ ID NO: 7610 - DNA, 601 bp, Human; identical to SEQ ID NO: 3734

SEQ ID NO: 7611 - DNA, 601 bp, Human; identical to SEQ ID NO: 3735

SEQ ID NO: 7612 - DNA, 601 bp, Human; identical to SEQ ID NO: 3736

SEQ ID NO: 7613 - DNA, 601 bp, Human; identical to SEQ ID NO: 3737

SEQ ID NO: 7614 - DNA, 601 bp, Human; identical to SEQ ID NO: 3738

SEQ ID NO: 7615 - DNA, 601 bp, Human; identical to SEQ ID NO: 3739

SEQ ID NO: 7616 - DNA, 601 bp, Human; identical to SEQ ID NO: 3740

SEQ ID NO: 7617 - DNA, 601 bp, Human; identical to SEQ ID NO: 3741

SEQ ID NO: 7618 - DNA, 601 bp, Human; identical to SEQ ID NO: 3742

SEQ ID NO: 7619 - DNA, 601 bp, Human; identical to SEQ ID NO: 3743

SEQ ID NO: 7620 - DNA, 601 bp, Human; identical to SEQ ID NO: 3744

SEQ ID NO: 7621 - DNA, 601 bp, Human; identical to SEQ ID NO: 3745

SEQ ID NO: 7622 - DNA, 601 bp, Human; identical to SEQ ID NO: 3746

SEQ ID NO: 7623 - DNA, 601 bp, Human; identical to SEQ ID NO: 3747

SEQ ID NO: 7624 - DNA, 601 bp, Human; identical to SEQ ID NO: 3748

SEQ ID NO: 7625 - DNA, 601 bp, Human; identical to SEQ ID NO: 3749

SEQ ID NO: 7626 - DNA, 601 bp, Human; identical to SEQ ID NO: 3750

SEQ ID NO: 7627 - DNA, 601 bp, Human; identical to SEQ ID NO: 3751

SEQ ID NO: 7628 - DNA, 601 bp, Human; identical to SEQ ID NO: 3752

SEQ ID NO: 7629 - DNA, 601 bp, Human; identical to SEQ ID NO: 3753

SEQ ID NO: 7630 - DNA, 601 bp, Human; identical to SEQ ID NO: 3754

SEQ ID NO: 7631 - DNA, 601 bp, Human; identical to SEQ ID NO: 3755

SEQ ID NO: 7632 - DNA, 601 bp, Human; identical to SEQ ID NO: 3756

SEQ ID NO: 7633 - DNA, 601 bp, Human; identical to SEQ ID NO: 3757

SEQ ID NO: 7634 - DNA, 601 bp, Human; identical to SEQ ID NO: 3758

SEQ ID NO: 7635 - DNA, 601 bp, Human; identical to SEQ ID NO: 3759

SEQ ID NO: 7636 - DNA, 601 bp, Human; identical to SEQ ID NO: 3760

SEQ ID NO: 7637 - DNA, 601 bp, Human; identical to SEQ ID NO: 3761

SEQ ID NO: 7638 - DNA, 601 bp, Human; identical to SEQ ID NO: 3762

SEQ ID NO: 7639 - DNA, 601 bp, Human; identical to SEQ ID NO: 3763

SEQ ID NO: 7640 - DNA, 601 bp, Human; identical to SEQ ID NO: 3764

SEQ ID NO: 7641 - DNA, 601 bp, Human; identical to SEQ ID NO: 3765

SEQ ID NO: 7642 - DNA, 601 bp, Human; identical to SEQ ID NO: 3766

SEQ ID NO: 7643 - DNA, 601 bp, Human; identical to SEQ ID NO: 3767

SEQ ID NO: 7644 - DNA, 601 bp, Human; identical to SEQ ID NO: 3768

SEQ ID NO: 7645 - DNA, 601 bp, Human; identical to SEQ ID NO: 3769

SEQ ID NO: 7646 - DNA, 601 bp, Human; identical to SEQ ID NO: 3770

SEQ ID NO: 7647 - DNA, 601 bp, Human; identical to SEQ ID NO: 3771

SEQ ID NO: 7648 - DNA, 601 bp, Human; identical to SEQ ID NO: 3772

SEQ ID NO: 7649 - DNA, 601 bp, Human; identical to SEQ ID NO: 3773

SEQ ID NO: 7650 - DNA, 601 bp, Human; identical to SEQ ID NO: 3774

SEQ ID NO: 7651 - DNA, 601 bp, Human; identical to SEQ ID NO: 3775

SEQ ID NO: 7652 - DNA, 601 bp, Human; identical to SEQ ID NO: 3776

SEQ ID NO: 7653 - DNA, 601 bp, Human; identical to SEQ ID NO: 3777

SEQ ID NO: 7654 - DNA, 601 bp, Human; identical to SEQ ID NO: 3778

SEQ ID NO: 7655 - DNA, 601 bp, Human; identical to SEQ ID NO: 3779

SEQ ID NO: 7656 - DNA, 601 bp, Human; identical to SEQ ID NO: 3780

SEQ ID NO: 7657 - DNA, 601 bp, Human; identical to SEQ ID NO: 3781

SEQ ID NO: 7658 - DNA, 601 bp, Human; identical to SEQ ID NO: 3782

SEQ ID NO: 7659 - DNA, 601 bp, Human; identical to SEQ ID NO: 3783

SEQ ID NO: 7660 - DNA, 601 bp, Human; identical to SEQ ID NO: 3784

SEQ ID NO: 7661 - DNA, 601 bp, Human; identical to SEQ ID NO: 3785

SEQ ID NO: 7662 - DNA, 601 bp, Human; identical to SEQ ID NO: 3786

SEQ ID NO: 7663 - DNA, 601 bp, Human; identical to SEQ ID NO: 3787

SEQ ID NO: 7664 - DNA, 601 bp, Human; identical to SEQ ID NO: 3788

SEQ ID NO: 7665 - DNA, 601 bp, Human; identical to SEQ ID NO: 3789

SEQ ID NO: 7666 - DNA, 601 bp, Human; identical to SEQ ID NO: 3790

SEQ ID NO: 7667 - DNA, 601 bp, Human; identical to SEQ ID NO: 3791

SEQ ID NO: 7668 - DNA, 601 bp, Human; identical to SEQ ID NO: 3792

SEQ ID NO: 7669 - DNA, 601 bp, Human; identical to SEQ ID NO: 3793

SEQ ID NO: 7670 - DNA, 601 bp, Human; identical to SEQ ID NO: 3794

SEQ ID NO: 7671 - DNA, 601 bp, Human; identical to SEQ ID NO: 3795

SEQ ID NO: 7672 - DNA, 601 bp, Human; identical to SEQ ID NO: 3796

SEQ ID NO: 7673 - DNA, 601 bp, Human
tgcccccgcttggcctcccaaagtgctgggattacaggcgtgagctaccacatccagcctattgatttcttttggagttttccttgtctgtcttcccatggaaggtatgagttccataaaagcagagatagtttgttttctttcctttcttttttctgagaaggagacttgctctgtctcccaggctggagtgcagtggcacaatctcggctcacactaacctctgcctctagggctcaaaggatcctcccgcctcagtctccagagtagctgggactacaggctcgcaccaccatgcccgccagttttttaattcttgtagaaatggggttttgctatgttgctcaggctggtctcgaactcctgacctcaagcgatcctcccgcctcagcctcccaaaatgctgagattataggcatgtgccaccaggctggcctgattttttttctttttgatcctctgctgtagtcccagctcttgaggcaggacttggcatacagtaagtgctcaataaatgccggttgaaggaaggataacgtcccagacaaggtggttgtgggtgtggggagcaggggacagcacttcctgggggaggcgatga

SEQ ID NO: 7674 - DNA, 601 bp, Human
ttcaagtgattctgctgcttcagcccccgagtagctgggattacaggcgcccgccatcacgctcagctgatttttttatttttagtagagacggggtttcaccatgttggtcagccttgtctcgaactcctgacctcaggtgatctgcccccgcttggcctcccaaagtgctgggattacaggcgtgagctaccacatccagcctattgatttcttttggagttttccttgtctgtcttcccatggaaggtatgagttccataaaagcagagatagtttgttttctttcctttcttttttytgagaaggagacttgctctgtctcccaggctggagtgcagtggcacaatctcggctcacactaacctctgcctctagggctcaaaggatcctcccgcctcagtctccagagtagctgggactacaggctcgcaccaccatgcccgccagttttttaattcttgtagaaatggggttttgctatgttgctcaggctggtctcgaactcctgacctcaagcgatcctcccgcctcagcctcccaaaatgctgagattataggcatgtgccaccaggctggcctgattttttttctttttgat

SEQ ID NO: 7675 - DNA, 601 bp, Human
tcggcctcccaaagtgctgggattacaggagtgagccaccgcgcccggccttcttttttttttttctaggtggagtctcactctgtcacccaggctggagtgccatggtgcaatcttggctcattgcaacctccgtctcccaagttcaagtgattctgctgcttcagcccccgagtagctgggattacaggcgcccgccatcacgctcagctgatttttttatttttagtagagacggggtttcaccatgttggtcagccttgtctcgaactcctgacctcaggtgatctgcccccgcttrgcctcccaaagtgctgggattacaggcgtgagctaccacatccagcctattgatttcttttggagttttccttgtctgtcttcccatggaaggtatgagttccataaaagcagagatagtttgttttctttcctttcttttttctgagaaggagacttgctctgtctcccaggctggagtgcagtggcacaatctcggctcacactaacctctgcctctagggctcaaaggatcctcccgcctcagtctccagagtagctgggactacaggctcgcaccaccatgcccgccagtttttta

SEQ ID NO: 7676 - DNA, 601 bp, Human
ctcggcctcccaaagtgctgggattacaggagtgagccaccgcgcccggccttcttttttttttttctaggtggagtctcactctgtcacccaggctggagtgccatggtgcaatcttggctcattgcaacctccgtctcccaagttcaagtgattctgctgcttcagcccccgagtagctgggattacaggcgcccgccatcacgctcagctgatttttttatttttagtagagacggggtttcaccatgttggtcagccttgtctcgaactcctgacctcaggtgatctgcccccgctyggcctcccaaagtgctgggattacaggcgtgagctaccacatccagcctattgatttcttttggagttttccttgtctgtcttcccatggaaggtatgagttccataaaagcagagatagtttgttttctttcctttcttttttctgagaaggagacttgctctgtctcccaggctggagtgcagtggcacaatctcggctcacactaacctctgcctctagggctcaaaggatcctcccgcctcagtctccagagtagctgggactacaggctcgcaccaccatgcccgccagtttttt

SEQ ID NO: 7677 - DNA, 601 bp, Human
gcctcggcctcccaaagtgctgggattacaggagtgagccaccgcgcccggccttcttttttttttttctaggtggagtctcactctgtcacccaggctggagtgccatggtgcaatcttggctcattgcaacctccgtctcccaagttcaagtgattctgctgcttcagcccccgagtagctgggattacaggcgcccgccatcacgctcagctgatttttttatttttagtagagacggggtttcaccatgttggtcagccttgtctcgaactcctgacctcaggtgatctgcccccgcttggcctcccaaagtgctgggattacaggcgtgagctaccacatccagcctattgatttcttttggagttttccttgtctgtcttcccatggaaggtatgagttccataaaagcagagatagtttgttttctttcctttcttttttctgagaaggagacttgctctgtctcccaggctggagtgcagtggcacaatctcggctcacactaacctctgcctctagggctcaaaggatcctcccgcctcagtctccagagtagctgggactacaggctcgcaccaccatgcccgccagtttt

SEQ ID NO: 7678 - DNA, 601 bp, Human
cccgcctcggcctcccaaagtgctgggattacaggagtgagccaccgcgcccggccttcttttttttttttctaggtggagtctcactctgtcacccaggctggagtgccatggtgcaatcttggctcattgcaacctccgtctcccaagttcaagtgattctgctgcttcagcccccgagtagctgggattacaggcgcccgccatcacgctcagctgatttttttatttttagtagagacggggtttcaccatgttggtcagccttgtctcgaactcctgacctcaggtgatctgcccycgcttggcctcccaaagtgctgggattacaggcgtgagctaccacatccagcctattgatttcttttggagttttccttgtctgtcttcccatggaaggtatgagttccataaaagcagagatagtttgttttctttcctttcttttttctgagaaggagacttgctctgtctcccaggctggagtgcagtggcacaatctcggctcacactaacctctgcctctagggctcaaaggatcctcccgcctcagtctccagagtagctgggactacaggctcgcaccaccatgcccgccagt

SEQ ID NO: 7679 - DNA, 601 bp, Human
cacccgcctcggcctcccaaagtgctgggattacaggagtgagccaccgcgcccggccttcttttttttttttctaggtggagtctcactctgtcacccaggctggagtgccatggtgcaatcttggctcattgcaacctccgtctcccaagttcaagtgattctgctgcttcagcccccgagtagctgggattacaggcgcccgccatcacgctcagctgatttttttatttttagtagagacggggtttcaccatgttggtcagccttgtctcgaactcctgacctcaggtgatctgcmcccgcttggcctcccaaagtgctgggattacaggcgtgagctaccacatccagcctattgatttcttttggagttttccttgtctgtcttcccatggaaggtatgagttccataaaagcagagatagtttgttttctttcctttcttttttctgagaaggagacttgctctgtctcccaggctggagtgcagtggcacaatctcggctcacactaacctctgcctctagggctcaaaggatcctcccgcctcagtctccagagtagctgggactacaggctcgcaccaccatgcccgcca

SEQ ID NO: 7680 - DNA, 386 bp, Human
cacccgcctcggcctcccaaagtgctgggattacaggagtgagccaccgcgcccggccttcttttttttttttctaggtggagtcycactctgtcacccaggctggagtgccatggtgcaatcttggctcattgcaacctccgtctcccaagttcaagtgattctgctgcttcagcccccgagtagctgggattacaggcgcccgccatcacgctcagctgatttttttatttttagtagagacggggtttcaccatgttggtcagccttgtctcgaactcctgacctcaggtgatctgcccccgcttggcctcccaaagtgctgggattacaggcgtgagctaccacatccagcctattgatttcttttggagttttccttgtct

SEQ ID NO: 7681 - DNA, 379 bp, Human
cacccgcctcggcctcccaaagtgctgggattacaggagtgagccaccgcgcccggccttcttttttttttttctaggyggagtctcactctgtcacccaggctggagtgccatggtgcaatcttggctcattgcaacctccgtctcccaagttcaagtgattctgctgcttcagcccccgagtagctgggattacaggcgcccgccatcacgctcagctgatttttttatttttagtagagacggggtttcaccatgttggtcagccttgtctcgaactcctgacctcaggtgatctgcccccgcttggcctcccaaagtgctgggattacaggcgtgagctaccacatccagcctattgatttcttttggagttttc

SEQ ID NO: 7682 - DNA, 601 bp, Human
gcacagtggctttctcccactgcttaatcccagtgctttaggttacagtgagctatgatgatgccactgcactccagcctgggtgatagagaaagaccctgtctataaaaattagaatagaccgggtgtggtggtttatgcctataatcacaataccttgggaggccaatgcaggaggatctcttgaggccaggagttcaagaccagcctgggcaacatagtgtgaccctcatctctataagaaatttaaaaaattagccaggcatggtgatgcacacctgtgtgatgcacagctactcargaggctgagacaggaggatcattgaacccaggaggttaaggctgcagtgagctgtgatcccaccactgtgctctagcctgggtgacagagtgagaccctgtctgaaaaacagacaaaaataacaataacaataaatattatttcacacttataccggccaggttcttgctaagtgctttacctgcagatagaggtattagcccagcactacatgtagtcagggtttagtaaatgttccctgcaggccaggtgcggtggctcatgcctgtaatcccagcactttgggaggccaaggtgggc

SEQ ID NO: 7683 - DNA, 601 bp, Human
aagatcacgccactgcactccagcctgggcaacagagtgagactatgtctcaaaagaacaaaacaatatggggctgggcacagtggctttctcccactgcttaatcccagtgctttaggttacagtgagctatgatgatgccactgcactccagcctgggtgatagagaaagaccctgtctataaaaattagaatagaccgggtgtggtggtttatgcctataatcacaataccttgggaggccaatgcaggaggatctcttgaggccaggagttcaagaccagcctgggcaacatagtgwgaccctcatctctataagaaatttaaaaaattagccaggcatggtgatgcacacctgtgtgatgcacagctactcaagaggctgagacaggaggatcattgaacccaggaggttaaggctgcagtgagctgtgatcccaccactgtgctctagcctgggtgacagagtgagaccctgtctgaaaaacagacaaaaataacaataacaataaatattatttcacacttataccggccaggttcttgctaagtgctttacctgcagatagaggtattagcccagcactacatgtagtcaggg

SEQ ID NO: 7684 - DNA, 601 bp, Human
gttgcccaggctggtcttgaactcctgggctcaagcgatcctcccacctcagcctcagcctcccaaagtgctgggattacaggtatgagccactgtgcccagcctcagcctctccctttaggctaagcaggtgagtgaagaggaggtcctcagatgttagtaattgtttagggatcaagtcttgcactccgggcccagtgggaagtccaagcttgtctaaattcccatccactgggcatctgagctcccactaaaccaggagaaaataaaccagttaaaaataacaacatggggccaggcrcggtggctcaaacctgtaatctcagcactttgggaggccgagatgggtggatcactcgaggccatgagtttgagaccagcctggccaacatggtgaaaccccgtctctgctaaaaatacaatacaaaatgagccaggtgtggtgacaggcacctgtaatctcagctactcgggaggctaaggcaggagaattgcttgaactggggaggtggaagttgcagtgaaccaagatcacgccactgcactccagcctgggcaacagagtgagactatgtctcaaaagaacaaaacaatatggggc

SEQ ID NO: 7685 - DNA, 601 bp, Human
agctagaactacaggcatgtacccccatgcccagcttttttaaatttttattttttgagacagagtcttgttctgtcacagggtcttggagtgcagtggtgtgatcactggctcactgcagcctcgacttccaaagttcaagcaatcctctgacctcagcctcctaagtagctgggataataggagtgtgccaccatgcctgttttttttgggggggggggcgggtggagggggtctttctatgttgcccaggctggtcttgaactcctgggctcaagcgatcctcccacctcagcctcascctcccaaagtgctgggattacaggtatgagccactgtgcccagcctcagcctctccctttaggctaagcaggtgagtgaagaggaggtcctcagatgttagtaattgtttagggatcaagtcttgcactccgggcccagtgggaagtccaagcttgtctaaattcccatccactgggcatctgagctcccactaaaccaggagaaaataaaccagttaaaaataacaacatggggccaggcacggtggctcaaacctgtaatctcagcactttgggaggccgagatgggtggatcactc

SEQ ID NO: 7686 - DNA, 601 bp, Human
tccaagggggataactctcaggtgcctgtgctacacagtctcccagggctccccagtgggattgagctctgggtctccaatggcaccattttattttaattaattaattaattaatttttgagacaggatctcactctgtcacccaggctgaagtgcagtgacataatcatagttcactgcagcctcaaactcctgggctcaagcaatcctcccactgcagcctcccaagtagctagaactacaggcatgtacccccatgcccagcttttttaaatttttattttttgagacagagtcttkttctgtcacagggtcttggagtgcagtggtgtgatcactggctcactgcagcctcgacttccaaagttcaagcaatcctctgacctcagcctcctaagtagctgggataataggagtgtgccaccatgcctgttttttttgggggggggggcgggtggagggggtctttctatgttgcccaggctggtcttgaactcctgggctcaagcgatcctcccacctcagcctcagcctcccaaagtgctgggattacaggtatgagccactgtgcccagcctcagcctctccctttaggctaag

SEQ ID NO: 7687 - DNA, 601 bp, Human
tggttcccatcaattttcatgtcactccccatctcggcctcggtgactcaccttcttccctcgacggaatgtgctataccagcctccaggcttttccttggaccaggaggccaatttcacctggaagagaaaagggagggtcactgtagctgacgcccttggtgccatctagatctcatctgcatttccctcctcacacagtaggctgttgtgactatgtcaggatgttctctggcttctgggatggacgagctctgccagtgcacaatgggggaaggaggttcatgcccctgaggcagcmctcacccaatgactaatgggagttggtggataaataccccagctccctcacctccaagggggataactctcaggtgcctgtgctacacagtctcccagggctccccagtgggattgagctctgggtctccaatggcaccattttattttaattaattaattaattaatttttgagacaggatctcactctgtcacccaggctgaagtgcagtgacataatcatagttcactgcagcctcaaactcctgggctcaagcaatcctcccactgcagcctcccaagtagctagaactacaggca

SEQ ID NO: 7688 - DNA, 601 bp, Human; identical to SEQ ID NO: 3797

SEQ ID NO: 7689 - DNA, 601 bp, Human; identical to SEQ ID NO: 3798

SEQ ID NO: 7690 - DNA, 601 bp, Human; identical to SEQ ID NO: 3799

SEQ ID NO: 7691 - DNA, 601 bp, Human; identical to SEQ ID NO: 3800

SEQ ID NO: 7692 - DNA, 601 bp, Human; identical to SEQ ID NO: 3801

SEQ ID NO: 7693 - DNA, 601 bp, Human; identical to SEQ ID NO: 3802

SEQ ID NO: 7694 - DNA, 601 bp, Human; identical to SEQ ID NO: 3803

SEQ ID NO: 7695 - DNA, 601 bp, Human; identical to SEQ ID NO: 3804

SEQ ID NO: 7696 - DNA, 601 bp, Human; identical to SEQ ID NO: 3805

SEQ ID NO: 7697 - DNA, 601 bp, Human; identical to SEQ ID NO: 3806

SEQ ID NO: 7698 - DNA, 601 bp, Human
aggagatcagcgggcttccttctggagaagttctagagactactgcccctggagtagatgagatcagtgggcttccttctggagaagttctagagactactgcccctggagtagaggagatcagcgggcttccttctggagaagttctagagacttctacctctgcggtaggggacctcagtggacttccttctggaggagaagttctagagatttctgtctctggagtagaggacatcagtgggcttccttctggagaggttgtagagacttctgcctctggaatagaggatgtcagtgmacttccttcaggagaaggtctagagacctctgcttctggagtagaggacctcagcaggctcccttctggagaagaagttctagagatttctgcctctggatttggggacctcagtggacttccttctggaggagaaggtctagagacctctgcttctgaagtagggactgacctcagtgggcttccttctggaagggagggtctagagacttcagcttctggagctgaggacctcagtgggttgccttctggaaaagaagacttggtggggtcagcttctggagacttggacttgggcaa

SEQ ID NO: 7699 - DNA, 601 bp, Human
acattggtggaagtggtcacagcctccactgcaagtgaactggaagggaggggaaccattggcatcagtggtgcaggagaaatatctggactgccctccagtgagctggacattagtgggagagctagtggactcccttcaggaactgaactcagtggccaagcatctgggtctcctgatgtcagtggggaaatacctggactctttggtgtcagtggacagccatcagggtttcctgacactagtggggaaacatctggagtgactgagcttagcgggctgtcctctggacaaccaggtrttagtggagaagcatctggagttctttatggcactagtcaaccctttggcataactgatctgagtggagaaacatctggggtccctgatctcagtgggcagccttcagggttaccagggttcagtggggcaacatcaggagtccctgacctggtttctggtaccacgagtggcagcggtgaatcttctgggattacatttgtggacaccagtttggttgaagtggcccctactacatttaaagaagaagaaggcttagggtctgtggaactcagtggcctcccttccggagaggcagatc

SEQ ID NO: 7700 - DNA, 601 bp, Human
ttccatcccagcttctccggaatggaaacgtgaatcagaatcaactgctgcaggtattgtgattttttccccctttaaatgtgcttaggtagttcagactgtagcctactgcagcacagaaggaggcagcatagctttaaggttccaagaacaactccaccaaaggttagctgtgcagcctcaggcaatagtcttcccctctctgagcctcatctgtaacgtaagagtaggataatactctaccagggaagattaggcagaacataaacatagatagataaagcaagcacttagcatcacrctctgcatgcagtgcacacttgtaaagatgagtgatgttatcgttacagcggagttacagtccgtgagtttttacacgtgaattcaactatctgtacttggcacagggagagaaggatgactgtctagatagtgctagaaattctgctcatgcaccctgccccggagtgagtgtaagatgagagagtaaatctgctgatggtgtttatgtctgaatatttattttgtgcagggttaaaacctgcacaacttaaggaactatgaagtgtcatttggctatctggttttagattctgcatcc

SEQ ID NO: 7701 - DNA, 601 bp, Human
gtgaatcagaatcaactgctgcaggtattgtgattttttccccctttaaatgtgcttaggtagttcagactgtagcctactgcagcacagaaggaggcagcatagctttaaggttccaagaacaactccaccaaaggttagctgtgcagcctcaggcaatagtcttcccctctctgagcctcatctgtaacgtaagagtaggataatactctaccagggaagattaggcagaacataaacatagatagataaagcaagcacttagcatcacgctctgcatgcagtgcacacttgtaaagaygagtgatgttatcgttacagcggagttacagtccgtgagtttttacacgtgaattcaactatctgtacttggcacagggagagaaggatgactgtctagatagtgctagaaattctgctcatgcaccctgccccggagtgagtgtaagatgagagagtaaatctgctgatggtgtttatgtctgaatatttattttgtgcagggttaaaacctgcacaacttaaggaactatgaagtgtcatttggctatctggttttagattctgcatccccaaccccatccgtgtacaaaggggctcc

SEQ ID NO: 7702 - DNA, 601 bp, Human
actttaaggtctggtctgctcttatgggaggcaagaactaagtcttggcacatgtttaggactctgagatcctattcccaccacagggcttcgctgtcctgcagagcccacctacagacatgtcactggatctggaaggctgtgtgaacacagctgcacatactgaggctcagtatcttcaaaccaatgtcatggtgccccatagccagtggaacccactcactgcagaattttactgatctcctggcaagaggagcttcataatagcatttatcatgttcccaggggaggaaaccaagtkgggggataaaacagcaggaacctttgaagtacaaatatgaagaaagcagaagagatcccccaggtcttctggtttctcagcaagatgcagaaagaccagatgaggagatttagttctcaccttggctaattcatgaaaatttgaggcaatggccaatgacttaccaattcaagtaccacaaagaagtttgatcagaaaggatatctcaggaccagaagaacagaagagaagagcctatctgaaaagaggcagaggatggggatgtgcctgtatcccagactggtgccagtgctgttgtgc

SEQ ID NO: 7703 - DNA, 601 bp, Human
aggaccagaagaacagaagagaagagcctatctgaaaagaggcagaggatggggatgtgcctgtatcccagactggtgccagtgctgttgtgcgaccacttgctaaccacctctgtagctccgaacgcttgtctcccactggccaggatggagtccctctagaacttgtgtctccctggagatagccaccttctggggccttaagctgaaaggagattatatggggaaatgttggacagggtttccatccctctcccgagagaaagattcaggcttcatttttataagagattctaaaatmatatctactgaagacaaagatgtctgcagcccaagaactctgatgggtctcacgcaaacatcccatgctgccattttcatatggatctacactcttcagaccatttcgaggtcattcattctagccccacacagccttgccctctttctctgggtcataactacaaaggaagccaggaaaagaaagacctctaaccaagcttcaggaacttgacttcagtttccttgctcaccaccacgttcataaccacttcagaatccatggtctctcaaaatattcacaagagaaggcatcttggag

SEQ ID NO: 7704 - DNA, 601 bp, Human
ggccctgggagccactgtgccacattggccaagctgcctttctcttctcctggggcaagagctgtggttggtctgcctgagatctcccgtgtcatcagcatgctcaagtcatgcatgagcaaggactgctgcatgtcaccttcttctcatcactattgtgacagctgccatggcaatgccatgccagcctatgcttcctttctccctcccttgtgcaaggcaaagggtggccagagagaacagaactgtgttacaagggggaggactgagttacctctcttgggccttgccaacctctccrtttctgcaccacttctaccaaaaggagctgtgcaccaggaaccctcccagggacagactgaaccctcagctctctcacctttggtgcttcctagtctccccaccagccgcctggatctcggggatttcccagctcagaaaaggggagatgagacctttggatacttgtctcagtggcccagacagaactggaagtgtgtaggggcttaaaatccttttcaatgaactctcaagttggatacccagaaacttccagaaggcaggtgaaactcctgggaagtctccctttggtcctaagcag

SEQ ID NO: 7705 - DNA, 601 bp, Human
acagagccacccagctcggccctgggcctgggggcccagctaagcagggctgcatctcctctcccattccaatcctgagtcctcaccactccacggtgcctcctgccttggctctgtccctgttacctctttcagtctggaattgtttctgtttcctaagaatcttcagcctgcacagccctgccctcccatacccacctcccagagaagttgcaccctccagctctgcctgcccagctcagcccttagccactgaaggggccaaaaactgaccccctaagtcagccctaagatgatatcyctggcctcttcagagtgctgagctagtctgaggcctctccacctctttccagactgcagcctcaccccttggggaaggcattcatagctgaggcaccagaggcctccacggcccctcctacagctctgttctttcttctcaagctgctgaccccctgttctgctctccctccactgtccccaactgtctctcccccactttgccaagcatccaccccttcagcctaagactccttcccctcgggtactggtccttccattccaggacagccagagtatggtggcacccaatcagggagac

SEQ ID NO: 7706 - DNA, 601 bp, Human
gctatctgacccctgcaagaggcaggcacagtgtgcttaactaaagccaactctgatcaacagccttagagctctgagtcttctccagaccccaagcagacttatttctgctcctctgttcccacctgaggttctgcaggaaggaaactgccagctccgctccatgccccagcgctaccagcttccactgcctccacacacttccccacagctccactccctctctccctggagccccccagagccacagaaccatgttttgccttaaatctcaagacctctcaccttcccacctcttttkaactggactgctgacctctgccggcccagcagagcaggcatcaagaggaggaaagcttgggagagggtgaggggggagggcgtggcatcagggaaggaaagggcccctggcattttcccgagtggaagcatgtgcagaggctcccagggaccagaccagtttccaacctgaactcctccagctgtgcctctcccttcccttgagggcacagcatggaaggtggggtgaacgcaggaacctatgccataagactggcagcatctgccatcccctggtggcctctgcccctcccttcaagcc

SEQ ID NO: 7707 - DNA, 601 bp, Human; identical to SEQ ID NO: 1555

SEQ ID NO: 7708 - DNA, 601 bp, Human; identical to SEQ ID NO: 7698

SEQ ID NO: 7709 - DNA, 601 bp, Human; identical to SEQ ID NO: 7699

SEQ ID NO: 7710 - DNA, 601 bp, Human; identical to SEQ ID NO: 7700

SEQ ID NO: 7711 - DNA, 601 bp, Human; identical to SEQ ID NO: 7701

SEQ ID NO: 7712 - DNA, 601 bp, Human; identical to SEQ ID NO: 7702

SEQ ID NO: 7713 - DNA, 601 bp, Human; identical to SEQ ID NO: 7703

SEQ ID NO: 7714 - DNA, 601 bp, Human; identical to SEQ ID NO: 7704

SEQ ID NO: 7715 - DNA, 601 bp, Human; identical to SEQ ID NO: 7705

SEQ ID NO: 7716 - DNA, 601 bp, Human; identical to SEQ ID NO: 7706

SEQ ID NO: 7717 - DNA, 601 bp, Human; identical to SEQ ID NO: 1555

SEQ ID NO: 7718 - DNA, 601 bp, Human
cctcgtcttggcctcctgcgctgtcgcgacgggccggcgtgaggcaccgtggcgcggacttcgtctcagccccgccctcgcccctgccctcgcccccgccctcgcccctgccctgaccgcttttctccccctctctcccagctcttgccgccacctcggtcgcgatgggggcgcaggaccggccgcagtgccacttcgacatcgagatcaaccgggagccgggtgagctggaaactggggagcgctgctggggccgaggcctgccttggcgaaggggaggggtctaccctcagcaaccctcccccggcctttttgggagcgggtaggaggcgcaggcaactttccgttttctcttgagagaaaatcagtgggagaggaaggtggcctgggcacacccctaactcgcagtccgggcctcttcctgccaaaccccacacaccccgctgcatctccggactgagtcctcgtagccagcctggcgccaagaaaaggaggtgcagttctttgaggactttttctctcccagtgtctccgtgaggcagacactcccgatccgatttccggttatcttgcttggtgctatgaagtttcaactagtagg

SEQ ID NO: 7719 - DNA, 601 bp, Human
ctttagggaatccagacatttgttagtgtattttttttaaatgaaacatttccttctaaagcatagttatttcattctaagtagcagagcgtgcagggtttcaaactgttttcttagctttttttgttatccgtgacaaaagttttaattggagacatatatatatgtgttgtctttgtgcaacatcttgttctgcatattcttatgagagcctgctactgttctagggtctggagatagagcagcgcataaaacaaaggcctcttccttttatagtttatattctattggggggaagacrgacaactaggaaaaaaataacagtgacttgtagttgggatactattttaataagttggtcagacaaggccattttgagaagatgagatttaagcaggtatcagaaggagatgaagtgagccgtatttaagaagagcattcgtggtagagggaaacagcacagccctgaggtgaggagtagtatacagtcaggcgccaaatgacatttctatctttaacaatggtcttatatataatacctttttttggtaactttttaatgtttagctgtgtttagatatacaaatacttcattgtgtta

SEQ ID NO: 7720 - DNA, 601 bp, Human
ttgtgcaacatcttgttctgcatattcttatgagagcctgctactgttctagggtctggagatagagcagcgcataaaacaaaggcctcttccttttatagtttatattctattggggggaagacagacaactaggaaaaaaataacagtgacttgtagttgggatactattttaataagttggtcagacaaggccattttgagaagatgagatttaagcaggtatcagaaggagatgaagtgagccgtatttaagaagagcattcgtggtagagggaaacagcacagccctgaggtgagragtagtatacagtcaggcgccaaatgacatttctatctttaacaatggtcttatatataatacctttttttggtaactttttaatgtttagctgtgtttagatatacaaatacttcattgtgttaaagttgcctacggtattcagtggagtaacatcctgtacaggtttgtagcctaggagcaaatagactatatagcttaggtgtgtagtaggccgtaccatctaggtgtgtttaaatacattccatgatgttcacacaatgacgaaattgcctaattacacatttctcagaatccgtc

SEQ ID NO: 7721 - DNA, 601 bp, Human
tatagtttatattctattggggggaagacagacaactaggaaaaaaataacagtgacttgtagttgggatactattttaataagttggtcagacaaggccattttgagaagatgagatttaagcaggtatcagaaggagatgaagtgagccgtatttaagaagagcattcgtggtagagggaaacagcacagccctgaggtgaggagtagtatacagtcaggcgccaaatgacatttctatctttaacaatggtcttatatataatacctttttttggtaactttttaatgtttagctgtrtttagatatacaaatacttcattgtgttaaagttgcctacggtattcagtggagtaacatcctgtacaggtttgtagcctaggagcaaatagactatatagcttaggtgtgtagtaggccgtaccatctaggtgtgtttaaatacattccatgatgttcacacaatgacgaaattgcctaattacacatttctcagaatccgtcctggttattaaacaatggaggactgtacttgcatgtttgagggacagcagggtgcccagtgtggctggagtagaagaggaaagagaatagtaagaa

SEQ ID NO: 7722 - DNA, 601 bp, Human
atctttaacaatggtcttatatataatacctttttttggtaactttttaatgtttagctgtgtttagatatacaaatacttcattgtgttaaagttgcctacggtattcagtggagtaacatcctgtacaggtttgtagcctaggagcaaatagactatatagcttaggtgtgtagtaggccgtaccatctaggtgtgtttaaatacattccatgatgttcacacaatgacgaaattgcctaattacacatttctcagaatccgtcctggttattaaacaatggaggactgtacttgcatrtttgagggacagcagggtgcccagtgtggctggagtagaagaggaaagagaatagtaagaaatggcctgtaggactgactcagtgaggtaggaagatattaaagggtttcgagcaaagggatgagataatcctggaaatttggttgccttctctctctttttaatgtttttagccttgattgatctttttttttttttttaaataagtgttactagaaagccttgatggaccttaatctttattttgtagtgaatccatgctttagataacagggttattttctattaagaattaaaaat

SEQ ID NO: 7723 - DNA, 601 bp, Human
aggtgtgtagtaggccgtaccatctaggtgtgtttaaatacattccatgatgttcacacaatgacgaaattgcctaattacacatttctcagaatccgtcctggttattaaacaatggaggactgtacttgcatgtttgagggacagcagggtgcccagtgtggctggagtagaagaggaaagagaatagtaagaaatggcctgtaggactgactcagtgaggtaggaagatattaaagggtttcgagcaaagggatgagataatcctggaaatttggttgccttctctctctttttaatrtttttagccttgattgatctttttttttttttttaaataagtgttactagaaagccttgatggaccttaatctttattttgtagtgaatccatgctttagataacagggttattttctattaagaattaaaaatagctcacgcctgtaatcccagcactttgggaggcagacgcgggtgtatcattttgaggtcaggagttcgagaccagcctggcctacatggcgaaaccccatctctacaaaaaataaaaaaattagctgggcatggtggctctcttagtttttgcctgtagtcccag

SEQ ID NO: 7724 - DNA, 601 bp, Human
tcttgtttctaaaaaaaaaaaaaaaaaaaaaaaaacagcttaagaaaaagtacaaataaaaatttctgtagttaagtactcctttcctagtaaatgttcagatcctagatttgcacataacctgtgttgtgaaaaatctccagaatatgtttgacaaatgttcaatgaacctcattcctcaacatccaaggcaattcattgtgatagatgtgtagatgtgattagcactcttgagaacgccgaatcatataaaacaaggaaatgcaatgcttacattgttctaggtttaatcatttgatarttggaaatttcatatggttcagtcttgtgaaataactagcactttttgagtatattaactaaatagtggattttacacaactttttttttttttttttttttgaggcgaagtctcactttttcacccaggctggagtgcagtggtgccatctcggctcagtgcaacctccgcctcccaggttcaagcgattctcctgcctcagcctccctagtagctgggattacaggcatgtgccaccacccctggctaatttttttgtatttttattagagacagggtttcatcatgttggccaggct

SEQ ID NO: 7725 - DNA, 601 bp, Human
caagtttatgtgcttagagttgtttgtcacagcctcttttaatatctgtggggtctgtagtggtgtctcttttcattcctgatattgataattcttccttttgtctttttcctttgtcagtctgacgagaggtttattcattatacattttcagagaaccagattttgatctgattgaattttgtttctatttttgttttcaatttcattgttctctttctttctaatgcttgcttcaatttttattttgttctttttctagtttcttaatgttgaagcatagattgttgatttgataccttttttttttgagacagtctcaaatgacttttaatttaattccattatggctagagaacacacatgatttccgttctttgtgcacttgaatgtacattctgcacttgaatgtacatttttgtgtagtgtgttctataaatgtcaaatccagttggctattagtgttggtcaattcttttatatctttgctgattttctacttgtttattgattaccaggagaagagtattgaagtctgcaactataacaactgtaattgtggatttatctatttctctccttttttttttttttttttttt

SEQ ID NO: 7726 - DNA, 601 bp, Human
gtataacaatcggataagcaggtggggaagagtggcgtgggagagaacagttggatagctctgctgctctgagtcattcttgtttgtcctaactgatttgaaggccactgtgctaatgacagtgctgggaatggaggcagaaatgaggtttggtcagttgtagggtttcctcaatgatgtttagattttataacgtcctcttatagctaaaatttattattgatactcctaaagaaaaaaatatttttactgcaactggaaactcccttgtcccccccagttcccatttttatatggaaayagttatttttatatgtgattttcgataatgcagtgtttcttaaaattctatcactgttcttgtagagcagtctgtatttgttaagtatatatagcacagtatctgattttttttttaagttgctttaagtattgcatgtgcaggagtatggacactaagtcaagttaaggggctttcatatttaggtattgtgcaggtagacctttgattttggtcccttttgttcccagagattgtatcttaaagtccgagagacagtgctgtaaagtgaaatcctgaattcttgctttcactccctat

SEQ ID NO: 7727 - DNA, 601 bp, Human
acttgtacaaagaattgaagcctgattcttaattcagcaatgtttattttattaaacaccaattaatctttatgtaatcactttttaacattttttaatattttgtctttacttttattttaaatttttatttttttcttggccaggcacagtggctcatgcttgtaatcccagcactttgggaggccaaggcaggaggattgcttgagcataggagttagaaacctaccagcctgggcaacatagtgagacactatccctaaaaaaaaaaatttcgtttggctttttttttagagacagrgtatcactgcgttgctcatgctggagtactgtggctattcacaggcatgatcatagtgtggtgtagcctcaaattcctggtctcaaatgatcctcccacctcagccttctgatacgtaatcacttttggtgactgtagtttaccctcatatgaagataccttgtattagttaggctaaatgataagattggttctaacataaaggttaaataacagtacttacaacaatataaaagttttgcttttctgtcacacagcactcagaatcagcagatcagggctgtccatgtgagggatcca

SEQ ID NO: 7728 - DNA, 601 bp, Human
atagtgtggtgtagcctcaaattcctggtctcaaatgatcctcccacctcagccttctgatacgtaatcacttttggtgactgtagtttaccctcatatgaagataccttgtattagttaggctaaatgataagattggttctaacataaaggttaaataacagtacttacaacaatataaaagttttgcttttctgtcacacagcactcagaatcagcagatcagggctgtccatgtgagggatccaggctctttttgtgtcgatactgtgttacttttgacatggggtgggtgcgtgcrgctcttaacagaaagattcaagtttaatagatacagaagaattgatggaatcagaagaatcatcattttgcaacccccatggtaataactggttcagaaagtagtcatcagtggccaaaccataggtgaaaagttgtgctgtgtgcaaagtatccaacagattatttatttaaaatggaggaaaattcctttacaactaagatgtggctaatatctcagttataaaggtactttaatgggtccgactgacatgctttctaatggggtgcaaaaaaaaaaagatggagactgttttagatt

SEQ ID NO: 7729 - DNA, 601 bp, Human
taggctgggtgtggtggctcatggcggtaatcccagcactttgggaggccgaggcaggcagatcacttgaggtcaggagttccagacaagcctggccaacgtggtgaaaccctgaccactaaaaagaagtacaaaaattagccgggcatggtggcgagcacctgtaatcacagctactcaggaggctaaggcaggagaattgcttgaacctgggaggtggagggtgcagtgagcagagatcataccactgcactcctgcctgggcaatagagcaagactcatatatcaaaaaaaaaaaaaaaagaaagatcaaatagaacaaaagatgctcctatcagtcctatcacttagaaaattacaagttttaggagcactgtgctagaaactggggacagaggtcaaatgtaggaactggggacagaggtcaaatgtaatgtttcatgttatgccacagctatggagtagatgataatcactattaaatttctttggtgtagtaatggttttggatttaagtagcagaatatctttattctttaggaatataagctgaagtattaataattaggggtgaagtgtcacagtgtctttaactttcagt

SEQ ID NO: 7730 - DNA, 601 bp, Human
agaaactggggacagaggtcaaatgtaggaactggggacagaggtcaaatgtaatgtttcatgttatgccacagctatggagtagatgataatcactattaaatttctttggtgtagtaatggttttggatttaagtagcagaatatctttattctttaggaatataagctgaagtattaataattaggggtgaagtgtcacagtgtctttaactttcagtttgttccagaagattgtgtgtttagagagggataaatatggcaaaacatctttgtagatttgaaaatttcaaaacaaaasttcaagaaggggaattgcacatttattctttcagacaaccttcaggatcattttgtcaagttccctcagaaatctcactggtatttttgaaggttgcaattaagttattataggttactctagggaatattgggcacatttgcaattttgagtcttgtctaagaacaaggtatctctccctttattcatgttggcattatgcctctcaaagttggagttttgtttttatagatcctatactcttatggttatgtaggtagaatgtttcttgttgtttttgagaatgtgatttttactgta

SEQ ID NO: 7731 - DNA, 601 bp, Human
gtgtcacagtgtctttaactttcagtttgttccagaagattgtgtgtttagagagggataaatatggcaaaacatctttgtagatttgaaaatttcaaaacaaaagttcaagaaggggaattgcacatttattctttcagacaaccttcaggatcattttgtcaagttccctcagaaatctcactggtatttttgaaggttgcaattaagttattataggttactctagggaatattgggcacatttgcaattttgagtcttgtctaagaacaaggtatctctccctttattcatgttggyattatgcctctcaaagttggagttttgtttttatagatcctatactcttatggttatgtaggtagaatgtttcttgttgtttttgagaatgtgatttttactgtatttttttctactagttcttgtttgtcataatataaatatcaacaacttcagtatctgttggtatttcagttggttcttttgggctttctaggtgtatagctaatgtttcaaatggtgataaatatgctcttttttacttgtaaatctctcatattgtcctcttatctacttacattgactagaatttcctttttt

SEQ ID NO: 7732 - DNA, 601 bp, Human
atctacttacattgactagaatttcctttttttttgagacagagtttcgctcttgttgcccaggctggagtgcaaaatggtgcaatctcggctcactgcaacctctgcctcctgcgttcaagcgattctcctgcctcagcctcccgagtagctgggattacaggagtgagccaccacacccgctaattttgtatttttagtagagacggggtttctccatgttggtcaggctggtctcgaactcccgacctcaggtgatccgcgccccccaccgcctcccaaagtgctgggattataggcrtgagctaccacgcctagcctacattgactagaatttctgaaagagcattaaacagtagtgatgctaacaactacttttgacttgtttcctgcttcactggaattaatgctacaggagtgtttcaccattaacgataatgctgattgttgatttgaaaaatatctgagaatatgtgtgtcatataaaggaatgaatgttgaatttcttttttttaatttatatttttcttttttaaaatttattttgttgtttctgtagtagatatgaatgttgaatttcaccgtgcacttttggtttcta

SEQ ID NO: 7733 - DNA, 601 bp, Human
ttcgattttattttgtttcaaaaaaattaagcttttcatcttttgctgtgctctagaacagttgatatagtgttacactttaatgttacttgaagattagaagtaattcatctatatctaaagaattaatagcagcactcttttggatagttagcagcattttagtttctttattgggcctgttttttatctgtatactatcttataattcttttttctaaattttggtattcttccttttatcttcctaagtgattaatttatctttagttttattcattaatgaaaatatttatgactrtatgcagtgatcaggataaataagtggtatttaacactttttgcattgtcagacctggcagctctaacatctgacctcatttcctgacatcctggccctttgattctctgatctgcactaatatcctcatcataactacatgagccagtaaatatgttctcttttgagtttttgcttgtactatctgcaggaaacctttagctgggtgtttatggacatgtcatggaaaaagcttcatgtggctaaataattaagttgtttcggccttatattttatgtttttctggctatttcctttgt

SEQ ID NO: 7734 - DNA, 601 bp, Human
cagcactcttttggatagttagcagcattttagtttctttattgggcctgttttttatctgtatactatcttataattcttttttctaaattttggtattcttccttttatcttcctaagtgattaatttatctttagttttattcattaatgaaaatatttatgactatatgcagtgatcaggataaataagtggtatttaacactttttgcattgtcagacctggcagctctaacatctgacctcatttcctgacatcctggccctttgattctctgatctgcactaatatcctcatcrtaactacatgagccagtaaatatgttctcttttgagtttttgcttgtactatctgcaggaaacctttagctgggtgtttatggacatgtcatggaaaaagcttcatgtggctaaataattaagttgtttcggccttatattttatgtttttctggctatttcctttgttttatatcttttactaggttgctgcccctcccaccaaagaagcttgaaagatgtaaaatattgttagttctacttgtgaatacctgtttaagtatgcttaaacccttggctgggcatggtggcctgtaatcc

SEQ ID NO: 7735 - DNA, 601 bp, Human
cctgtttaagtatgcttaaacccttggctgggcatggtggcctgtaatcccagcactctgggaggtcgaggcgggcaaatcacaaggttaggagttcaagacaagcctggccaacatggtgaaaccccatctctactaaaaatacaaaaaattagctgggcatagtggtaggtgtctataatcctagctactcgggaggctgaggcaggagaattgcttgaacccaggaggcggagattgcagtgagccaagatcgtgccactgcactccagcctgggtgacagagtgagactctgtctcaaaaaaaaaaaaaaaaatgtatgcctaaacccttatttcctctctgcttcagaaaagtctacctattgattcccactatgaagtatgaggatgcgtattttctttcaccagtccaaatccttgttggtttttattgattctccactgccttcctccaactgaaattatttttaccctgggcaacatagtgagaccttgtctcaacaaaaaatacaaaaattagccaagcatggtggcatgctcctatgttcccatctattcaggaggctgaggcaggaggattgcttgagcccaagaggtt

SEQ ID NO: 7736 - DNA, 601 bp, Human
aaagtctacctattgattcccactatgaagtatgaggatgcgtattttctttcaccagtccaaatccttgttggtttttattgattctccactgccttcctccaactgaaattatttttaccctgggcaacatagtgagaccttgtctcaacaaaaaatacaaaaattagccaagcatggtggcatgctcctatgttcccatctattcaggaggctgaggcaggaggattgcttgagcccaagaggttgaggatgcagtgagcagaggttgtgccgttgcactacaacctggggaacagarcgagactctgtctcttaaaaaataaaatacattatttttatatcacaggcatgagaaaagttcatgatatgttagtaaagcaaggtgcagtacagtgtgcataatctaccattttttaaaggaagaaaaataagaatttatcaatatttgcttgtgtatgaaaagaaactggaaaaatacacagaaaattaatgaaagtgagtacctgttgatagggttgggaaacaaggcttctcatcctgtacctttttccactgatttttgagtcatgagaacattacctattcaaaagaaagaaca

SEQ ID NO: 7737 - DNA, 601 bp, Human
tattgattctccactgccttcctccaactgaaattatttttaccctgggcaacatagtgagaccttgtctcaacaaaaaatacaaaaattagccaagcatggtggcatgctcctatgttcccatctattcaggaggctgaggcaggaggattgcttgagcccaagaggttgaggatgcagtgagcagaggttgtgccgttgcactacaacctggggaacagagcgagactctgtctcttaaaaaataaaatacattatttttatatcacaggcatgagaaaagttcatgatatgttagtaragcaaggtgcagtacagtgtgcataatctaccattttttaaaggaagaaaaataagaatttatcaatatttgcttgtgtatgaaaagaaactggaaaaatacacagaaaattaatgaaagtgagtacctgttgatagggttgggaaacaaggcttctcatcctgtacctttttccactgatttttgagtcatgagaacattacctattcaaaagaaagaacattttcagatggtacataaaaaaaattttgccattacataactttgtttcctaatactgataacatttaaaaccataat

SEQ ID NO: 7738 - DNA, 601 bp, Human
actacaacctggggaacagagcgagactctgtctcttaaaaaataaaatacattatttttatatcacaggcatgagaaaagttcatgatatgttagtaaagcaaggtgcagtacagtgtgcataatctaccattttttaaaggaagaaaaataagaatttatcaatatttgcttgtgtatgaaaagaaactggaaaaatacacagaaaattaatgaaagtgagtacctgttgatagggttgggaaacaaggcttctcatcctgtacctttttccactgatttttgagtcatgagaacattwcctattcaaaagaaagaacattttcagatggtacataaaaaaaattttgccattacataactttgtttcctaatactgataacatttaaaaccataattaacactgtttgcattgtcatacctggcagctctaacatccggcctcatttccttttattttaaaaccataattatagtgatttaggtttaattttgtaatgtaatatattcagtgcccaatgccactcttcctactagttctcattcattaattttttgacttatatctcagggatatgtattcaaatagatatttcagga

SEQ ID NO: 7739 - DNA, 601 bp, Human
ttaattttgtaatgtaatatattcagtgcccaatgccactcttcctactagttctcattcattaattttttgacttatatctcagggatatgtattcaaatagatatttcaggataaaatgtatttcctttgctaggtatagaattcttgtttcacagcctattccttaaaaatggtagactgtgctcagttgtctccagtttgtaatataaggtgtctgaagctggtcttctttcttttttctttgtgaacgatatgattctactgcctggatactaggaggcttttttttccatttatrtctccaaaactaaatagctttattaattgatatcttggtgttgctccacttacatattttttcctggtatgtagtgaataattttaatctgtatatttgggtgttccttcatttatgaaagtattttgtaaatctgtctttgaataattttgttttgagtattattattattaaatatttattgagcacctaactgtaccaggcactacgtaagtctctggggatatagtggtaagtaaagcagtcatggtccctatctctctgcggtcacacacaacagtcagacctaggttatatata

SEQ ID NO: 7740 - DNA, 601 bp, Human
gtctgaatatccatagttcagcctttgccatgctttgcaaacctaattaggttaatgtgtttttttcaggattttaaaattatttttcttatgtgccaggtttaatcttgcaccttgttattgaggcaaaaacaattcagttttgttgtatttttcctcttgctcttaacaacataatgccatagaggagataaaacctctactctatcctttgtgccatgaggttcggagggcaaaagacttttttttttgctccaggctagaagagggtaagatattagaggtgagatttgttttttctttgttttttttttaagatggaatcttactgtgtcgcgcaggctggagtgcagtgatgcaacctcagctcactgcaacctccacctcccaggttcaagcgattcttttgcctcagcctcccgagtagctaggattacaggcgcctgccaccacacctggctaatttttgtatttttagtagagatggggtttcatcatgttggccaggctgatcttgaactcctgacctcaggtgatctgcctgccttggcctcccaaagtgctgggattacaggcgtgagccaccatgcctggccgagat

SEQ ID NO: 7741 - DNA, 601 bp, Human
tgaatatccatagttcagcctttgccatgctttgcaaacctaattaggttaatgtgtttttttcaggattttaaaattatttttcttatgtgccaggtttaatcttgcaccttgttattgaggcaaaaacaattcagttttgttgtatttttcctcttgctcttaacaacataatgccatagaggagataaaacctctactctatcctttgtgccatgaggttcggagggcaaaagacttttttttttgctccaggctagaagagggtaagatattagaggtgagatttgttttttctttkttttttttttaagatggaatcttactgtgtcgcgcaggctggagtgcagtgatgcaacctcagctcactgcaacctccacctcccaggttcaagcgattcttttgcctcagcctcccgagtagctaggattacaggcgcctgccaccacacctggctaatttttgtatttttagtagagatggggtttcatcatgttggccaggctgatcttgaactcctgacctcaggtgatctgcctgccttggcctcccaaagtgctgggattacaggcgtgagccaccatgcctggccgagatttt

SEQ ID NO: 7742 - DNA, 601 bp, Human
attacaagattttgaaaaaaacaaaacaaaaaacaccctaatgttgaagttactgtggccctaagaaaagccctatgttttgattatttcgattatgtcttctatcctgaaaagtagccatcttacagggattgcaaagatctaagtctgttctggtatgcaaagcgggatgattttgaacttgacaccagctaagccatttcccagagatttatgaggactgatcaaaatacatttattatactggtaaaatgtttctatataaatacagtgatagttactattactgatattatagggkttttttttaattctgaaatgactttagatacactgctccctgcttgaaaatcttgagtcctcctttttgcttgctttccgtctttttcttcattcccttaggttttaagaacagctacaaagttttgaaattgctttatagtttggctcttttaaagctataggctaagaatgttgacacaggaaggtcttccatcctgctttacccattaacgatgtctataatgcagtatcattgtttcctcctcacaggaactgaccgatatggccaggaatacaatacagtcttagtgatacagag

SEQ ID NO: 7743 - DNA, 601 bp, Human; identical to SEQ ID NO: 3284

SEQ ID NO: 7744 - DNA, 601 bp, Human; identical to SEQ ID NO: 3285

SEQ ID NO: 7745 - DNA, 601 bp, Human; identical to SEQ ID NO: 3286

SEQ ID NO: 7746 - DNA, 601 bp, Human; identical to SEQ ID NO: 3287

SEQ ID NO: 7747 - DNA, 601 bp, Human; identical to SEQ ID NO: 3288

SEQ ID NO: 7748 - DNA, 601 bp, Human; identical to SEQ ID NO: 3289

SEQ ID NO: 7749 - DNA, 601 bp, Human; identical to SEQ ID NO: 3290

SEQ ID NO: 7750 - DNA, 601 bp, Human; identical to SEQ ID NO: 3291

SEQ ID NO: 7751 - DNA, 601 bp, Human; identical to SEQ ID NO: 3292

SEQ ID NO: 7752 - DNA, 601 bp, Human; identical to SEQ ID NO: 3293

SEQ ID NO: 7753 - DNA, 601 bp, Human; identical to SEQ ID NO: 3294

SEQ ID NO: 7754 - DNA, 601 bp, Human; identical to SEQ ID NO: 3295

SEQ ID NO: 7755 - DNA, 601 bp, Human; identical to SEQ ID NO: 3296

SEQ ID NO: 7756 - DNA, 601 bp, Human; identical to SEQ ID NO: 3297

SEQ ID NO: 7757 - DNA, 601 bp, Human; identical to SEQ ID NO: 3298

SEQ ID NO: 7758 - DNA, 601 bp, Human; identical to SEQ ID NO: 3299

SEQ ID NO: 7759 - DNA, 601 bp, Human; identical to SEQ ID NO: 3300

SEQ ID NO: 7760 - DNA, 601 bp, Human; identical to SEQ ID NO: 3301

SEQ ID NO: 7761 - DNA, 601 bp, Human; identical to SEQ ID NO: 3302

SEQ ID NO: 7762 - DNA, 601 bp, Human; identical to SEQ ID NO: 3303

SEQ ID NO: 7763 - DNA, 601 bp, Human; identical to SEQ ID NO: 3304

SEQ ID NO: 7764 - DNA, 601 bp, Human; identical to SEQ ID NO: 3305

SEQ ID NO: 7765 - DNA, 601 bp, Human; identical to SEQ ID NO: 3306

SEQ ID NO: 7766 - DNA, 601 bp, Human; identical to SEQ ID NO: 3307

SEQ ID NO: 7767 - DNA, 601 bp, Human; identical to SEQ ID NO: 3308

SEQ ID NO: 7768 - DNA, 601 bp, Human; identical to SEQ ID NO: 3309

SEQ ID NO: 7769 - DNA, 601 bp, Human; identical to SEQ ID NO: 3310

SEQ ID NO: 7770 - DNA, 601 bp, Human; identical to SEQ ID NO: 3311

SEQ ID NO: 7771 - DNA, 601 bp, Human; identical to SEQ ID NO: 3312

SEQ ID NO: 7772 - DNA, 601 bp, Human; identical to SEQ ID NO: 3313

SEQ ID NO: 7773 - DNA, 601 bp, Human
ctagtaagagtcccttactcagcacctgctcagttctcaactgacacttttgttgtagggagacgccacgtctatgcgggatgggtccttcctgtagccccaggcacccaggtgtggtaggagccttagaaagaagaaatggggagaatcttctgagcacagggagggaggggcagctcaacatactcctctctgaggcggcatctccttctccccaaggtggtcaggacaagcccttctgctctgcctggcccagcgctgtggtgcctcaaggaggacacgtgactcttcggtgtcactrtcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtcagagggctcctgtctgggcttctccttgtcccacctcctgagtcccagagcttctggtgggggtgtccaccagagtccgatcatccaggcccca

SEQ ID NO: 7774 - DNA, 601 bp, Human
atcatggtcacaggtcagagggctcctgtctgggcttctccttgtcccacctcctgagtcccagagcttctggtgggggtgtccaccagagtccgatcatccaggccccaactatatttggggtaaagggggattgaatacaggggaatgggtgctgtgttggaaagaataactgtccccatcgatggccacattgtaatccttggagcctgtgactatgttatagggcaggggactgaaggggaagatggagctcaggttgttgatgagttgaccttgagatggggagatggcctggacyctcccactgggctcagtgtaatcacaagggtccatatgagtggagaaggaagaggagaatggggattagagcagcatcgtgggatactccaccagccactgtgggctttgaaggtggaggaagaccacgagccacgaaggggctggagaaatcaatggaactgattctcccgagtctccagagggaatgcagccctgcagatgccttgattgtagcccaggaagaacagggtctgatttctgtctccagaagtggaaggggtcagtgtgttctctcctgccgccatgtttgtgataattt

SEQ ID NO: 7775 - DNA, 601 bp, Human
gagcctgtgactatgttatagggcaggggactgaaggggaagatggagctcaggttgttgatgagttgaccttgagatggggagatggcctggactctcccactgggctcagtgtaatcacaagggtccatatgagtggagaaggaagaggagaatggggattagagcagcatcgtgggatactccaccagccactgtgggctttgaaggtggaggaagaccacgagccacgaaggggctggagaaatcaatggaactgattctcccgagtctccagagggaatgcagccctgcagatgcmttgattgtagcccaggaagaacagggtctgatttctgtctccagaagtggaaggggtcagtgtgttctctcctgccgccatgtttgtgataattttctccagcaacaacaggaaaccaacacaggaacccaggtgaaggacaagttaaaaaaccaaacaagaaggttggctaccctgagatcagcaagggtgcactgctgatgccaccaccaggctggaaccacatagggagggatcgacaggaagagttgggggtggagggtgagagagagagagagagagagagcactaggccataga

SEQ ID NO: 7776 - DNA, 601 bp, Human
gatggggagatggcctggactctcccactgggctcagtgtaatcacaagggtccatatgagtggagaaggaagaggagaatggggattagagcagcatcgtgggatactccaccagccactgtgggctttgaaggtggaggaagaccacgagccacgaaggggctggagaaatcaatggaactgattctcccgagtctccagagggaatgcagccctgcagatgccttgattgtagcccaggaagaacagggtctgatttctgtctccagaagtggaaggggtcagtgtgttctctcctgycgccatgtttgtgataattttctccagcaacaacaggaaaccaacacaggaacccaggtgaaggacaagttaaaaaaccaaacaagaaggttggctaccctgagatcagcaagggtgcactgctgatgccaccaccaggctggaaccacatagggagggatcgacaggaagagttgggggtggagggtgagagagagagagagagagagagcactaggccatagagcagggcagtgagttctcagctcaggtgggaggggagctgtgacaaggaagaacctccctgaggaaactgcctct

SEQ ID NO: 7777 - DNA, 601 bp, Human
cagtaagggctccgggtacccaggcagatggagaaagtggtcaggacagacccagaggagggagactgggctcagtttggggagatcagaggttccctcagcccctcaaccttacccatttcccagaagcccaccctggcctctcacctacacagagatgtcatcaccagcaacccctacactttttcttttcctttgaaaaaatgctgattgaggttaaatatacctatataatttatcaactttaccatttttaagtgtaaaatctagggatcataaatacctttatatgctgtgtgcrgtggctcacgcctgtaatctcagcattttgagacgccaaggcaggtggatcatttaaaatcaggggctggagaccagcctggccaacatgggggaaccaatctttactaaaaagacaaaaaaaataaaattagccaggcatggtgccaggcgcctataatcccagcaacttgggaggctgaggcgggagagtggcttaaacccaggaggaggaggttgcagtgagctgagatcatgccactgcactgcagcctggtgacacagagagactctgtctctaaataaataaataaatactttt

SEQ ID NO: 7778 - DNA, 601 bp, Human
ctccgggtacccaggcagatggagaaagtggtcaggacagacccagaggagggagactgggctcagtttggggagatcagaggttccctcagcccctcaaccttacccatttcccagaagcccaccctggcctctcacctacacagagatgtcatcaccagcaacccctacactttttcttttcctttgaaaaaatgctgattgaggttaaatatacctatataatttatcaactttaccatttttaagtgtaaaatctagggatcataaatacctttatatgctgtgtgcggtggctcaygcctgtaatctcagcattttgagacgccaaggcaggtggatcatttaaaatcaggggctggagaccagcctggccaacatgggggaaccaatctttactaaaaagacaaaaaaaataaaattagccaggcatggtgccaggcgcctataatcccagcaacttgggaggctgaggcgggagagtggcttaaacccaggaggaggaggttgcagtgagctgagatcatgccactgcactgcagcctggtgacacagagagactctgtctctaaataaataaataaatacttttatattcttc

SEQ ID NO: 7779 - DNA, 601 bp, Human
ggagatcagaggttccctcagcccctcaaccttacccatttcccagaagcccaccctggcctctcacctacacagagatgtcatcaccagcaacccctacactttttcttttcctttgaaaaaatgctgattgaggttaaatatacctatataatttatcaactttaccatttttaagtgtaaaatctagggatcataaatacctttatatgctgtgtgcggtggctcacgcctgtaatctcagcattttgagacgccaaggcaggtggatcatttaaaatcaggggctggagaccagccyggccaacatgggggaaccaatctttactaaaaagacaaaaaaaataaaattagccaggcatggtgccaggcgcctataatcccagcaacttgggaggctgaggcgggagagtggcttaaacccaggaggaggaggttgcagtgagctgagatcatgccactgcactgcagcctggtgacacagagagactctgtctctaaataaataaataaatacttttatattcttcttttgttaccctccaccccttccttcctaacctctggtatccaccattctactctctaccttcatgaggtc

SEQ ID NO: 7780 - DNA, 601 bp, Human
cttgggaggctgaggcgggagagtggcttaaacccaggaggaggaggttgcagtgagctgagatcatgccactgcactgcagcctggtgacacagagagactctgtctctaaataaataaataaatacttttatattcttcttttgttaccctccaccccttccttcctaacctctggtatccaccattctactctctaccttcatgaggtccaccttttacatcctgcatgtgagtaagaaatggcaatccttgtaatgacctccagtccatccatgtggctgcaaatgacaggacgttwctctttgtatggatgagttgtctccattgtgtgtatgtactacattctctctatccattcatccactgatgggcaggtaggttgactccacatcttggctactgtgaacagtgctggaacagtcatgggagtgcagatgtcacttcaatacactgaagtccttttctttgcatttacacccactagtggaattgctagatcctctggatgttctctttttaggttttgttttatgctttttgtttttttgacatagcgtttcactcttgttgcccaagctggagtgcaatggcaccacct

SEQ ID NO: 7781 - DNA, 601 bp, Human
tgacctccagtccatccatgtggctgcaaatgacaggacgttactctttgtatggatgagttgtctccattgtgtgtatgtactacattctctctatccattcatccactgatgggcaggtaggttgactccacatcttggctactgtgaacagtgctggaacagtcatgggagtgcagatgtcacttcaatacactgaagtccttttctttgcatttacacccactagtggaattgctagatcctctggatgttctctttttaggttttgttttatgctttttgtttttttgacatagcktttcactcttgttgcccaagctggagtgcaatggcaccacctgggctcactgcaacctctacctccaggattcaagtgattctccagcctcagcctcccgagtagttgggattactggtgcccgccaccacgcctggctgatttttgtatttttagtagagacggggtttcaccatgttagccaggctggtctcgaactcttgacctccagtgatctgcccacttcagcctcccaaggtgctgggattacaagcgtgagccacagtgcctaatctctttttagtttttaaggaacttcca

SEQ ID NO: 7782 - DNA, 601 bp, Human
tgtgtttttgaggttttaaacaaaatgtcttccctcagacaaatgtcctggagcatttctccagtgtttccttttagacatttaatggattcaggtcttaagtcattaatccattttcatctgatttttgtgtatggtgagaggtagaggtgcagtttcatccctctgcatgtagatatccagttttccctgcaccatttattgaaatgactgtcctttccagattgtagattcttcgaacctttgtcaaagtccattggatgtaaatgggtggattacatccgtgttcttcattctgctycattgttttatgtgcttttctttatgccaatgtcatgttgttttgcttactacagctctgtaacatatttttaagtcaggtagtgtgatgctcctgttttctccttataccttgaagtctcaagatagttggtgtcacctacaatgattatggagaatgggatgccaggactcccagggcccaacattagataatagaatgttggccatgaaccaacctcaaagatttccattgagtagaagacaggcatcctcattgccacacctctctcctgtcccatgttctaggaaacccttctag

SEQ ID NO: 7783 - DNA, 601 bp, Human
cctggagcatttctccagtgtttccttttagacatttaatggattcaggtcttaagtcattaatccattttcatctgatttttgtgtatggtgagaggtagaggtgcagtttcatccctctgcatgtagatatccagttttccctgcaccatttattgaaatgactgtcctttccagattgtagattcttcgaacctttgtcaaagtccattggatgtaaatgggtggattacatccgtgttcttcattctgctccattgttttatgtgcttttctttatgccaatgtcatgttgttttgyttactacagctctgtaacatatttttaagtcaggtagtgtgatgctcctgttttctccttataccttgaagtctcaagatagttggtgtcacctacaatgattatggagaatgggatgccaggactcccagggcccaacattagataatagaatgttggccatgaaccaacctcaaagatttccattgagtagaagacaggcatcctcattgccacacctctctcctgtcccatgttctaggaaacccttctagtagttggccttcacccactgaaccaagcttcaaaactggtaagtga

SEQ ID NO: 7784 - DNA, 601 bp, Human
attgaaatgactgtcctttccagattgtagattcttcgaacctttgtcaaagtccattggatgtaaatgggtggattacatccgtgttcttcattctgctccattgttttatgtgcttttctttatgccaatgtcatgttgttttgcttactacagctctgtaacatatttttaagtcaggtagtgtgatgctcctgttttctccttataccttgaagtctcaagatagttggtgtcacctacaatgattatggagaatgggatgccaggactcccagggcccaacattagataatagaakgttggccatgaaccaacctcaaagatttccattgagtagaagacaggcatcctcattgccacacctctctcctgtcccatgttctaggaaacccttctagtagttggccttcacccactgaaccaagcttcaaaactggtaagtgaaggacccctcttatctctgcttttggaaacctggggaggtagaagccttggattcaagcgttggctcagcacctgccagctctgtgattgtgggcctgtcttccattgtctctgaaccccagacactccaacagcgaaagggatctgggcccag

SEQ ID NO: 7785 - DNA, 601 bp, Human
cctttgtcaaagtccattggatgtaaatgggtggattacatccgtgttcttcattctgctccattgttttatgtgcttttctttatgccaatgtcatgttgttttgcttactacagctctgtaacatatttttaagtcaggtagtgtgatgctcctgttttctccttataccttgaagtctcaagatagttggtgtcacctacaatgattatggagaatgggatgccaggactcccagggcccaacattagataatagaatgttggccatgaaccaacctcaaagatttccattgagtagaagacaggcatcctcattgccacacctctctcctgtcccatgttctaggaaacccttctagtagttggccttcacccactgaaccaagcttcaaaactggtaagtgaaggacccctcttatctctgcttttggaaacctggggaggtagaagccttggattcaagcgttggctcagcacctgccagctctgtgattgtgggcctgtcttccattgtctctgaaccccagacactccaacagcgaaagggatctgggcccagcacagggctcagtgaaatctcttaatctctaattttctgc

SEQ ID NO: 7786 - DNA, 601 bp, Human
atccgtgttcttcattctgctccattgttttatgtgcttttctttatgccaatgtcatgttgttttgcttactacagctctgtaacatatttttaagtcaggtagtgtgatgctcctgttttctccttataccttgaagtctcaagatagttggtgtcacctacaatgattatggagaatgggatgccaggactcccagggcccaacattagataatagaatgttggccatgaaccaacctcaaagatttccattgagtagaagacaggcatcctcattgccacacctctctcctgtcccrtgttctaggaaacccttctagtagttggccttcacccactgaaccaagcttcaaaactggtaagtgaaggacccctcttatctctgcttttggaaacctggggaggtagaagccttggattcaagcgttggctcagcacctgccagctctgtgattgtgggcctgtcttccattgtctctgaaccccagacactccaacagcgaaagggatctgggcccagcacagggctcagtgaaatctcttaatctctaattttctgctgctgagacctcagggtagaaggatgagtgcaaatcaga

SEQ ID NO: 7787 - DNA, 601 bp, Human
ttttggaaacctggggaggtagaagccttggattcaagcgttggctcagcacctgccagctctgtgattgtgggcctgtcttccattgtctctgaaccccagacactccaacagcgaaagggatctgggcccagcacagggctcagtgaaatctcttaatctctaattttctgctgctgagacctcagggtagaaggatgagtgcaaatcagacattcttctcaggaaaaatgctgtgtttgttctgcctgcattcctaactgggaggacaaatgcctgggggcttgagaaggggaaggamggggaacatttttgagggtggtgtatttgtagagaagttctacttgccaaggaatgagctcctgtctgtcatgatccaaccctggttgacttagtggaacaagagctttgcggtaagagagaacgtagttcatccgtgcacatgacacttccacttactcgttcagccactgccccatgctcagactgtgcagtgtggaaccttttcctatgttgccataacaaatttccacaagcttcgtggatggaaaccacatttttaaaaaatatctcatggtgctgtagctcagaagtatgaaat

SEQ ID NO: 7788 - DNA, 601 bp, Human
agcgaaagggatctgggcccagcacagggctcagtgaaatctcttaatctctaattttctgctgctgagacctcagggtagaaggatgagtgcaaatcagacattcttctcaggaaaaatgctgtgtttgttctgcctgcattcctaactgggaggacaaatgcctgggggcttgagaaggggaaggacggggaacatttttgagggtggtgtatttgtagagaagttctacttgccaaggaatgagctcctgtctgtcatgatccaaccctggttgacttagtggaacaagagctttgcrgtaagagagaacgtagttcatccgtgcacatgacacttccacttactcgttcagccactgccccatgctcagactgtgcagtgtggaaccttttcctatgttgccataacaaatttccacaagcttcgtggatggaaaccacatttttaaaaaatatctcatggtgctgtagctcagaagtatgaaatgcatcatctcactgggctaaaatcaaggtgacagcaaggctgccttccctctgaatgttccaggcaagaatctgcttcctcacttttcccagctcctagaggctcccacatt

SEQ ID NO: 7789 - DNA, 601 bp, Human
tgcaaatcagacattcttctcaggaaaaatgctgtgtttgttctgcctgcattcctaactgggaggacaaatgcctgggggcttgagaaggggaaggacggggaacatttttgagggtggtgtatttgtagagaagttctacttgccaaggaatgagctcctgtctgtcatgatccaaccctggttgacttagtggaacaagagctttgcggtaagagagaacgtagttcatccgtgcacatgacacttccacttactcgttcagccactgccccatgctcagactgtgcagtgtggaacyttttcctatgttgccataacaaatttccacaagcttcgtggatggaaaccacatttttaaaaaatatctcatggtgctgtagctcagaagtatgaaatgcatcatctcactgggctaaaatcaaggtgacagcaaggctgccttccctctgaatgttccaggcaagaatctgcttcctcacttttcccagctcctagaggctcccacattccttggctcctggtccccgtcttcctccctcaaagtccacaaaggctggtcacgcctctcacacggcatcactcagacccttcttccttg

SEQ ID NO: 7790 - DNA, 601 bp, Human
ccgtcttcctccctcaaagtccacaaaggctggtcacgcctctcacacggcatcactcagacccttcttccttgtccacacctctttctctgaatgctgctctgccttcttcctcatcttttaaggactttggcattctattggaaacaccaagataatccatcataatttccctaaaatcatctaggataccctccttttaaggttagctgattagcaaccgtaattccatctgcaatctgcattccttttttccatgtaaaataacatattcacaagatatggcgactaggacaggaayattttggggtggggcggcattcttatcctttccacaaatggtaaacaaggtgcatttggcctctgctcttggacactgatattgcaaaggattaaatgggagggcagaaaatgaatgcaccagtggaccaataaatgaatgatccattgggaagcatctgtgcatgagaatgattgattgattggttgtttttatgagacggtgtctccctctgtgccccaggctggagtgcagtggcgggatctcggctcaccgcaacctccacctcccaggttaaagcgattctctacactcagcttc

SEQ ID NO: 7791 - DNA, 601 bp, Human
cttttaaggactttggcattctattggaaacaccaagataatccatcataatttccctaaaatcatctaggataccctccttttaaggttagctgattagcaaccgtaattccatctgcaatctgcattccttttttccatgtaaaataacatattcacaagatatggcgactaggacaggaacattttggggtggggcggcattcttatcctttccacaaatggtaaacaaggtgcatttggcctctgctcttggacactgatattgcaaaggattaaatgggagggcagaaaatgaatrcaccagtggaccaataaatgaatgatccattgggaagcatctgtgcatgagaatgattgattgattggttgtttttatgagacggtgtctccctctgtgccccaggctggagtgcagtggcgggatctcggctcaccgcaacctccacctcccaggttaaagcgattctctacactcagcttcccgagaggctgggattacacccatgtcccaccacgcctggctaatttttttttggtatttttttttagtacagacaaggttttaccatgttgcccaggctatctcaaactcccaacc

SEQ ID NO: 7792 - DNA, 601 bp, Human
agtgctgagattagaggcgtgagccaaggcgccgagccgtattttaaaagaaataatagataatgctgagtgtataatttcgggtgacagagaagttctcactgatcaaataatacttgtgaccttaatgaaaaaaatagatcaacccctggaagattggcggaaggattttccacacagctgtcagccgtgaaggcacaaaggtgaaaacaatgttatgtggaaggaagaggctctgcctgaaatgctgggaatgacatggggagaatgacaagacgactgtggagagacagagagcacwctgggtacacaggaaactaaggaggaacaaggagcgtgtgtttgatactcacagccattggacttacctcggggctaactgggaatccctacatgatgaatagtgactgacatgaaaataagggaggcccaggtgcataactggaatctaggagactgtggaaaaggcaattcccgcccccctggtgaaatgtggtgctgatttagacactaaatgaatgaaagatggacacaagatgtgtttgtgaggtagagtaatttgcagggagggcttgcctggtttgatttttcctaattgttt

SEQ ID NO: 7793 - DNA, 601 bp, Human
aaggcgccgagccgtattttaaaagaaataatagataatgctgagtgtataatttcgggtgacagagaagttctcactgatcaaataatacttgtgaccttaatgaaaaaaatagatcaacccctggaagattggcggaaggattttccacacagctgtcagccgtgaaggcacaaaggtgaaaacaatgttatgtggaaggaagaggctctgcctgaaatgctgggaatgacatggggagaatgacaagacgactgtggagagacagagagcacactgggtacacaggaaactaaggagsaacaaggagcgtgtgtttgatactcacagccattggacttacctcggggctaactgggaatccctacatgatgaatagtgactgacatgaaaataagggaggcccaggtgcataactggaatctaggagactgtggaaaaggcaattcccgcccccctggtgaaatgtggtgctgatttagacactaaatgaatgaaagatggacacaagatgtgtttgtgaggtagagtaatttgcagggagggcttgcctggtttgatttttcctaattgtttaatcttcacttcattgatttctttc

SEQ ID NO: 7794 - DNA, 601 bp, Human
cagtccctcaaggctcagaaaaactgctcaggacacatggagtcacttcatgtgcactgtagctgggggaagccagaaagcagcccagcctgggttttgtaccctggagccacagggaacactcagctaaagcactgcatgatgttctcctccaggaagaacaggaagacagcccaggctgttctgagacgttcctcctgatctcaggatgttgctgtcttagcctatttttgttgctataaaagaacacttgagcctgggtatcttctaaagaaaagagatgtgtttggctcactgatckgcacgctgtactagaagcaggacactaccatctatttctggctgcggcctcaggctgctcccacactgacagaagagaagggggtcctgcgtgtgcagagaccacagagatcacatggcaagagagggagaaagggggtgtgatggagcttccaagctctttttaagaatcaactctccagggtactaatagagggagaacttgctaaccccgtcctctggggacagcattaatctattcatgatggatccacccccatgaccaaaacacccctcccaataggcacaacctcccacactg

SEQ ID NO: 7795 - DNA, 601 bp, Human
tgttgctgtcttagcctatttttgttgctataaaagaacacttgagcctgggtatcttctaaagaaaagagatgtgtttggctcactgatctgcacgctgtactagaagcaggacactaccatctatttctggctgcggcctcaggctgctcccacactgacagaagagaagggggtcctgcgtgtgcagagaccacagagatcacatggcaagagagggagaaagggggtgtgatggagcttccaagctctttttaagaatcaactctccagggtactaatagagggagaacttgctaamcccgtcctctggggacagcattaatctattcatgatggatccacccccatgaccaaaacacccctcccaataggcacaacctcccacactggggattaaatttcaaagtggggtttggaggggtcaaacattgaaacaatagcagttgtatcatcagcacattctattgttattatgaaaactataacggagaaagcaggagaaagctgggtctcccgcctcgtgggtgcttgtcttaaagaggtgttttatgtggttgcctggcaaccaagaaatgagagacaatccacaaagaggaac

SEQ ID NO: 7796 - DNA, 601 bp, Human
gctcactgatctgcacgctgtactagaagcaggacactaccatctatttctggctgcggcctcaggctgctcccacactgacagaagagaagggggtcctgcgtgtgcagagaccacagagatcacatggcaagagagggagaaagggggtgtgatggagcttccaagctctttttaagaatcaactctccagggtactaatagagggagaacttgctaaccccgtcctctggggacagcattaatctattcatgatggatccacccccatgaccaaaacacccctcccaataggcacaacctcccacactggggattaaatttcaaagtggggtttggaggggtcaaacattgaaacaatagcagttgtatcatcagcacattctattgttattatgaaaactataacggagaaagcaggagaaagctgggtctcccgcctcgtgggtgcttgtcttaaagaggtgttttatgtggttgcctggcaaccaagaaatgagagacaatccacaaagaggaactgctatggttagcttcttattggattcccatcttcctccaggtatcgccagacacctgcatgctgtgattaggtactcag

SEQ ID NO: 7797 - DNA, 601 bp, Human
ggagcttccaagctctttttaagaatcaactctccagggtactaatagagggagaacttgctaaccccgtcctctggggacagcattaatctattcatgatggatccacccccatgaccaaaacacccctcccaataggcacaacctcccacactggggattaaatttcaaagtggggtttggaggggtcaaacattgaaacaatagcagttgtatcatcagcacattctattgttattatgaaaactataacggagaaagcaggagaaagctgggtctcccgcctcgtgggtgcttgtcytaaagaggtgttttatgtggttgcctggcaaccaagaaatgagagacaatccacaaagaggaactgctatggttagcttcttattggattcccatcttcctccaggtatcgccagacacctgcatgctgtgattaggtactcagtggccatcatcctctttaccatccttcccttctttctccttcatcgctggtgctccaaaaaaaaagtaagcctcacgaagcagaggccagagaactcagggccctgtgcggaagcaggatgggagcacgcaggtgtgtgttcctcactggcaggaa

SEQ ID NO: 7798 - DNA, 601 bp, Human
attcatgatggatccacccccatgaccaaaacacccctcccaataggcacaacctcccacactggggattaaatttcaaagtggggtttggaggggtcaaacattgaaacaatagcagttgtatcatcagcacattctattgttattatgaaaactataacggagaaagcaggagaaagctgggtctcccgcctcgtgggtgcttgtcttaaagaggtgttttatgtggttgcctggcaaccaagaaatgagagacaatccacaaagaggaactgctatggttagcttcttattggattcycatcttcctccaggtatcgccagacacctgcatgctgtgattaggtactcagtggccatcatcctctttaccatccttcccttctttctccttcatcgctggtgctccaaaaaaaaagtaagcctcacgaagcagaggccagagaactcagggccctgtgcggaagcaggatgggagcacgcaggtgtgtgttcctcactggcaggaaagtctctggcccaaggcaggagccagaggcagagctttctagagagagcaccagacaccctgcccctgccttcagctcacagaccgttgcct

SEQ ID NO: 7799 - DNA, 601 bp, Human
taaatttcaaagtggggtttggaggggtcaaacattgaaacaatagcagttgtatcatcagcacattctattgttattatgaaaactataacggagaaagcaggagaaagctgggtctcccgcctcgtgggtgcttgtcttaaagaggtgttttatgtggttgcctggcaaccaagaaatgagagacaatccacaaagaggaactgctatggttagcttcttattggattcccatcttcctccaggtatcgccagacacctgcatgctgtgattaggtactcagtggccatcatcctcttyaccatccttcccttctttctccttcatcgctggtgctccaaaaaaaaagtaagcctcacgaagcagaggccagagaactcagggccctgtgcggaagcaggatgggagcacgcaggtgtgtgttcctcactggcaggaaagtctctggcccaaggcaggagccagaggcagagctttctagagagagcaccagacaccctgcccctgccttcagctcacagaccgttgcctgattgtgaactgtatcctcacgtcccctgcagccactcacatccaggagaagattccatgacaggcaga

SEQ ID NO: 7800 - DNA, 601 bp, Human
ggattcccatcttcctccaggtatcgccagacacctgcatgctgtgattaggtactcagtggccatcatcctctttaccatccttcccttctttctccttcatcgctggtgctccaaaaaaaaagtaagcctcacgaagcagaggccagagaactcagggccctgtgcggaagcaggatgggagcacgcaggtgtgtgttcctcactggcaggaaagtctctggcccaaggcaggagccagaggcagagctttctagagagagcaccagacaccctgcccctgccttcagctcacagaccrttgcctgattgtgaactgtatcctcacgtcccctgcagccactcacatccaggagaagattccatgacaggcagaaagtgggagatagaatcaatgggatgggaactgacagctattcatggaatggggtcttgcactcagagagatggaatgtctgagtctggctgttggcagctgagggacctcaggcacctatggcctccccctgtgtgttggtatctgttcatgaaatgaggacccagaagtgccctcccagctgttttgattgcttccgtctcctacagatgctgctgtaatgaa

SEQ ID NO: 7801 - DNA, 601 bp, Human
gggagatagaatcaatgggatgggaactgacagctattcatggaatggggtcttgcactcagagagatggaatgtctgagtctggctgttggcagctgagggacctcaggcacctatggcctccccctgtgtgttggtatctgttcatgaaatgaggacccagaagtgccctcccagctgttttgattgcttccgtctcctacagatgctgctgtaatgaaccaagagcctgcgggacacagaacagtgaacagggaggtaggtcctcctagcccagcctcatggatacagtcttattccsaaatagtcctgaaaaatgtgaacaccctccctcactcaggatttccctctctccaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagct

SEQ ID NO: 7802 - DNA, 601 bp, Human
ggagatagaatcaatgggatgggaactgacagctattcatggaatggggtcttgcactcagagagatggaatgtctgagtctggctgttggcagctgagggacctcaggcacctatggcctccccctgtgtgttggtatctgttcatgaaatgaggacccagaagtgccctcccagctgttttgattgcttccgtctcctacagatgctgctgtaatgaaccaagagcctgcgggacacagaacagtgaacagggaggtaggtcctcctagcccagcctcatggatacagtcttattccgwaatagtcctgaaaaatgtgaacaccctccctcactcaggatttccctctctccaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctc

SEQ ID NO: 7803 - DNA, 601 bp, Human
gctgtaatgaaccaagagcctgcgggacacagaacagtgaacagggaggtaggtcctcctagcccagcctcatggatacagtcttattccgaaatagtcctgaaaaatgtgaacaccctccctcactcaggatttccctctctccaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagascgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttc

SEQ ID NO: 7804 - DNA, 601 bp, Human
ctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctmttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttcattctttaggtgactctttttttggctgaaagtttccagtgttatcattaccatgtccaaataactccaactgttctccactgggttctcacccctggactcggagcttctggaagcagggtggagcctgatttgtctctgagac

SEQ ID NO: 7805 - DNA, 601 bp, Human; identical to SEQ ID NO: 3156

SEQ ID NO: 7806 - DNA, 601 bp, Human
aacgtgggttcggagcagggggcggcgtccgcgtctgacccggcctgccggttgcttgtcgcccgcgcaggagctggccgggcgccgcctgcaggctgtcccgggccgagtcggagcgacgctgccgcgcacctgggcagcccccgggggccgcgctgtgccacggccggggccgctgcgactgcggcgtctgcatctgccacgtgactgagccgggcatgttcttcgggcccctgtgtgagtgccatgagtgggtgtgcgagacctacgacgggagcacctgtgcaggtaagagggcggygctgtctcctccctcgggaggtcgaaactcctcttctgggatttctgccactccctagaagagtgaagggtggggacacgcctcccttcacataagcaccaattaagttactgcgattgtcacactttggctagttaattctggcatcatttatcacaacacttttatcccccaggctctgaacttgaatggaagtaaagttttaaaaattcattcacttaattatatattttattgtaattatgattttttaaagttgggatcttgctatgttgccctggctggtcccccccccccccc

SEQ ID NO: 7807 - DNA, 601 bp, Human
gtgattcaggttctgatattggaaagggtcaaaaaattccttcccagagaacacccttaacctctttacctgtgtcgttttacttaaggccaagagcctcaattagtgccttgtgagtgacacagaactccattagtgaaagcacaacacaatgcattccagccagggtttggcaaatttgtaggaaaaaccagccacttattttaccctcaatgtagctaagaataataagacagccaacactaacatagaaagatcaagaatgagtttatagcaaaatatttttttctcagagcctggkcccagtagtgtataagttacttaatatgcaggctgcttggcaatgcaaaaaatagtcatagaagaaatttggaggggcgcaggtgcatctacttgatttgttttccctgtgaaggctgtggatcaactctttaaaaatactgaatgctgggtggggtggctcacacctgtaatcccagcactttgggaggccgaggcaggtgaatcacttgaggtcaggagttcaagaccagcctcgccaacttgctgaaacccagtctctactaaaaatacaaaaattagctgggcgtcgtggcatgtg

SEQ ID NO: 7808 - DNA, 601 bp, Human
tttccctgtgaaggctgtggatcaactctttaaaaatactgaatgctgggtggggtggctcacacctgtaatcccagcactttgggaggccgaggcaggtgaatcacttgaggtcaggagttcaagaccagcctcgccaacttgctgaaacccagtctctactaaaaatacaaaaattagctgggcgtcgtggcatgtgcctgtaatcccagctacttgggaggccgaggcagaattgcttgaacctgggaggcagaggttgcagagagccaagatcatgccactgcactccagcctgggygacagagcgagacttcatctcaataaataaattaataaataaaattaaaatattggatgccacaacttgttatttaacttcgcagtcctacaaaccgcagtataattaagggtagccctttggaatgaaagctaagttaccgcctaatatttcattccaaatttgactgttacttggcttctctgacctatggcctctggcaagccctcttcaatatcatgaattttgaacaaattttccagggctttttctcttgttttattagagaagtaagaggtaagatgcagcctttaactggtg

SEQ ID NO: 7809 - DNA, 601 bp, Human
ttccctgtgaaggctgtggatcaactctttaaaaatactgaatgctgggtggggtggctcacacctgtaatcccagcactttgggaggccgaggcaggtgaatcacttgaggtcaggagttcaagaccagcctcgccaacttgctgaaacccagtctctactaaaaatacaaaaattagctgggcgtcgtggcatgtgcctgtaatcccagctacttgggaggccgaggcagaattgcttgaacctgggaggcagaggttgcagagagccaagatcatgccactgcactccagcctgggcracagagcgagacttcatctcaataaataaattaataaataaaattaaaatattggatgccacaacttgttatttaacttcgcagtcctacaaaccgcagtataattaagggtagccctttggaatgaaagctaagttaccgcctaatatttcattccaaatttgactgttacttggcttctctgacctatggcctctggcaagccctcttcaatatcatgaattttgaacaaattttccagggctttttctcttgttttattagagaagtaagaggtaagatgcagcctttaactggtga

SEQ ID NO: 7810 - DNA, 601 bp, Human
gcaggtgaatcacttgaggtcaggagttcaagaccagcctcgccaacttgctgaaacccagtctctactaaaaatacaaaaattagctgggcgtcgtggcatgtgcctgtaatcccagctacttgggaggccgaggcagaattgcttgaacctgggaggcagaggttgcagagagccaagatcatgccactgcactccagcctgggcgacagagcgagacttcatctcaataaataaattaataaataaaattaaaatattggatgccacaacttgttatttaacttcgcagtcctacaarccgcagtataattaagggtagccctttggaatgaaagctaagttaccgcctaatatttcattccaaatttgactgttacttggcttctctgacctatggcctctggcaagccctcttcaatatcatgaattttgaacaaattttccagggctttttctcttgttttattagagaagtaagaggtaagatgcagcctttaactggtgaaagttgtgagtgtcgtcagattcactttccctgttgaagaacctaggctggtgcttttctccgagaaactatgcagaaggaatgctgtggtag

SEQ ID NO: 7811 - DNA, 601 bp, Human
cacttgaggtcaggagttcaagaccagcctcgccaacttgctgaaacccagtctctactaaaaatacaaaaattagctgggcgtcgtggcatgtgcctgtaatcccagctacttgggaggccgaggcagaattgcttgaacctgggaggcagaggttgcagagagccaagatcatgccactgcactccagcctgggcgacagagcgagacttcatctcaataaataaattaataaataaaattaaaatattggatgccacaacttgttatttaacttcgcagtcctacaaaccgcagtatwattaagggtagccctttggaatgaaagctaagttaccgcctaatatttcattccaaatttgactgttacttggcttctctgacctatggcctctggcaagccctcttcaatatcatgaattttgaacaaattttccagggctttttctcttgttttattagagaagtaagaggtaagatgcagcctttaactggtgaaagttgtgagtgtcgtcagattcactttccctgttgaagaacctaggctggtgcttttctccgagaaactatgcagaaggaatgctgtggtagacagcattct

SEQ ID NO: 7812 - DNA, 601 bp, Human
tcatctcaataaataaattaataaataaaattaaaatattggatgccacaacttgttatttaacttcgcagtcctacaaaccgcagtataattaagggtagccctttggaatgaaagctaagttaccgcctaatatttcattccaaatttgactgttacttggcttctctgacctatggcctctggcaagccctcttcaatatcatgaattttgaacaaattttccagggctttttctcttgttttattagagaagtaagaggtaagatgcagcctttaactggtgaaagttgtgagtgtygtcagattcactttccctgttgaagaacctaggctggtgcttttctccgagaaactatgcagaaggaatgctgtggtagacagcattcttttttccctcccatagaaaatgatatgttgtttactcatagcatcttagtcactgcattccttccttcttgatacgaaatgcaggactgagtcaagcatggttttgtttggttatgcatgcatttctgtagaagatgaaatgcttctctttattttaatactgaatggaataatgaagttcattttttattctcatcttgctgactgatgc

SEQ ID NO: 7813 - DNA, 601 bp, Human
aattaagggtagccctttggaatgaaagctaagttaccgcctaatatttcattccaaatttgactgttacttggcttctctgacctatggcctctggcaagccctcttcaatatcatgaattttgaacaaattttccagggctttttctcttgttttattagagaagtaagaggtaagatgcagcctttaactggtgaaagttgtgagtgtcgtcagattcactttccctgttgaagaacctaggctggtgcttttctccgagaaactatgcagaaggaatgctgtggtagacagcattcytttttccctcccatagaaaatgatatgttgtttactcatagcatcttagtcactgcattccttccttcttgatacgaaatgcaggactgagtcaagcatggttttgtttggttatgcatgcatttctgtagaagatgaaatgcttctctttattttaatactgaatggaataatgaagttcattttttattctcatcttgctgactgatgcccatcaaaacttactctacagggccttgagcagaatctgtccccgcaaatgccctgaccacgtttgtggggcccatgcggagatcccta

SEQ ID NO: 7814 - DNA, 601 bp, Human
ttctctgacctatggcctctggcaagccctcttcaatatcatgaattttgaacaaattttccagggctttttctcttgttttattagagaagtaagaggtaagatgcagcctttaactggtgaaagttgtgagtgtcgtcagattcactttccctgttgaagaacctaggctggtgcttttctccgagaaactatgcagaaggaatgctgtggtagacagcattcttttttccctcccatagaaaatgatatgttgtttactcatagcatcttagtcactgcattccttccttcttgataygaaatgcaggactgagtcaagcatggttttgtttggttatgcatgcatttctgtagaagatgaaatgcttctctttattttaatactgaatggaataatgaagttcattttttattctcatcttgctgactgatgcccatcaaaacttactctacagggccttgagcagaatctgtccccgcaaatgccctgaccacgtttgtggggcccatgcggagatccctacaagtagcacctagggctgccttgcgagcccgtcgatgtattccatgcttcaaatttagcttctcagttttattt

SEQ ID NO: 7815 - DNA, 601 bp, Human
tgccctgaccacgtttgtggggcccatgcggagatccctacaagtagcacctagggctgccttgcgagcccgtcgatgtattccatgcttcaaatttagcttctcagttttatttttaagagatagttccagttgtatcactggaatatggaaatatagcaggtttcctatgtttatgtgcccctgtgctttcacctccatgaaagttcctgtaggtcctttccagaaatagagtaactttcggagacctctccaacttctaagaagaaaacaaaatccttctcttatagtactatatcayggagtgattaaaagtgtgggctctgggctgggtgtggtggttcatgcctataatcctagcactttggaagcctgaagcaggtggattacctgaggtcaggattcaagactagcctggagaacatggtgaaacaccatccctactaaaaaacacaaaaattagctgggcttggtggcatgtgcctgtaatcccagctacttggaaggctgaggcaggagaatcgcttgaacccggcaggcagaggttgcagtgagctgagatgatgccgttgcactctagcctaggaaacaagaatgagac

SEQ ID NO: 7816 - DNA, 601 bp, Human
gatagatagctggcccagtgtttgttgggcatttaatgcagtgagagcaatttacttctcttcatgtagtctgggtctgttactgattcaaggcccaaaaagtcaagtagggataactattttggcccagcctcagggcagctgtattagatacactatgcccttttaaagttaagtccattgggattattatactgtgaatcataagaaccatacttattatagtttgcgctggttgaaagtgattaggttccctccattagaagtctgtttcttccagtgtccacttgttcgtggcacrtgcatcttccacagacttttatagcataaagatccagccaagtgagtgttcctatggatgtgatggtctattaaggggtaaaataattttggtagaatggtgaaaccctgtctctactaaatatacaaaaattagctgggtgtgatggtgtgcgccttgtagtcccagctactcgggaggctgaggcaggagaattgcttgaacccaggaggcagaggttgcagtgagccaagattgcgccattgcactccagcctgagtgacagaacgacactccatcacaaaaaaggaaagaaaaaaa

SEQ ID NO: 7817 - DNA, 601 bp, Human
attagaagtctgtttcttccagtgtccacttgttcgtggcacgtgcatcttccacagacttttatagcataaagatccagccaagtgagtgttcctatggatgtgatggtctattaaggggtaaaataattttggtagaatggtgaaaccctgtctctactaaatatacaaaaattagctgggtgtgatggtgtgcgccttgtagtcccagctactcgggaggctgaggcaggagaattgcttgaacccaggaggcagaggttgcagtgagccaagattgcgccattgcactccagcctgrgtgacagaacgacactccatcacaaaaaaggaaagaaaaaaagaaagaatggcaaaatgtttgattgcatggaaagaaactttcagttgatatttctaaagcattcctggttgaccccatgaccagctacaatgacacttaaataatgtattgttttcttagaaatcttttgaaattgctgttgaaatatgtcacttaaagagtttcagttttagtaatttaggaagagctaattgaattcaatttagcaacacttatgaagcactgcatattttctaggctctgtcctgttgaagggag

SEQ ID NO: 7818 - DNA, 601 bp, Human
aagcaaccagctgtcctgtgaacaaatagagaactcactcatgaccttggggagggcaccaagccattcatgagggatccacccccataacccaaacacttcccacttgattccacctacaagattggggatcacatttcaacatgagatttggaggggacacacatccaaactatatcacacagagacagacataccttgccctggactaggtcatccctgcaccttgatgatctagaggaacatatttatagcattgtggtatttagataaaatagtataaatgtgagaaattcaggarttattttctatgtaaagtttccccagaatgagaaaggaaaggaacatatggaaacaaatttatttgtattacaaattttaaatttgcaaaacataaacctccctcataaggttctcagagtcttcaatatattttgaaacacaatgctaaaactgacatcgcatgttcttgatatcataaacccccacaaaagctgctcagctctctgagcctcatatacatattgttacatctgaccttgtgactcaccatgttcatgttcttgaggtaggtgatcaatgccctaggagggactgggtg

SEQ ID NO: 7819 - DNA, 601 bp, Human
acccccacaaaagctgctcagctctctgagcctcatatacatattgttacatctgaccttgtgactcaccatgttcatgttcttgaggtaggtgatcaatgccctaggagggactgggtgtagtggctcacatcgcctgtaatcctagcactttgggaagttgaggtgggaggatccttgaagcccagtggtttgagaccggcctgggcagcatagcgagacctgctccctactaaaaattttttaaaaattgccagacccagtggtgggtgactgtagtgccagctatcaggaggctaakacaggaggctcatttgagcatgggagattgaggctgcagtgagctatgatcaggccactgcactccagcctaggtgagagaattagaccctgtctcaaaaaaataaaataaaaaattccctgggagcagagagccccgttatcattctttgggggaattccctgtctgcaaaattatgaagtaagacgagacattttgccaagcttcatatcctgcccttgtattatttttctattgctgctacaacaaattaccacaaaccttgaggcttaaacagctcagatgtcttttctagagttc

SEQ ID NO: 7820 - DNA, 601 bp, Human
agttcctgacattgtcacttgcccactgtggagctacagggaggttacccaagaggttacaacctctgtttccttatggttgaaaagagggcaataataagaccaaatagggataatgacagtgccaaacacatatgagtgattaataaatcactggagttattatgcttaaatatgctagacacccctctcctaccctagcgtaattcctggtcctaagatatttattttcaaataagcaattttctttccatgttatatcttcctccattactaaattcatgtcttggaattactctgrtagtctttgaactattatatcccaacaagcttgcctactctatagtgccagggctgggtgtgccctcagccctggccagcatgaggaatctgagagcttactgtatcatgccccaactcactgcactgccagccgtctgagtcttgtatatgtctttgtctcagaacctgccttttgtgttcctgtccctgaaatctgtaccctgatttatatgatcataattgatctaatggaatgctccagaaccctaccctcagaactgtataattagtccttgaatttggaattttcatgcttttt

SEQ ID NO: 7821 - DNA, 601 bp, Human
actctgatagtctttgaactattatatcccaacaagcttgcctactctatagtgccagggctgggtgtgccctcagccctggccagcatgaggaatctgagagcttactgtatcatgccccaactcactgcactgccagccgtctgagtcttgtatatgtctttgtctcagaacctgccttttgtgttcctgtccctgaaatctgtaccctgatttatatgatcataattgatctaatggaatgctccagaaccctaccctcagaactgtataattagtccttgaatttggaattttcatkctttttctctgctggaaacctttagacgtctgcagactcccagggcttactctataagtgcaattctgcttctgactcttccctccactgagatgcctgtacttctagggtgttccttgatctcctctaaattgttgatcccaaataggttgatcccagaaactgcttcttcagttgcaaaactgcagaaagcaacacaataaaaaaacaaaatcaaaataactcacatatttttaaaaatatgtaataaacattactgaatgttgtggagacattgggttgtgtgttatttaatcataa

SEQ ID NO: 7822 - DNA, 601 bp, Human
gcttgcctactctatagtgccagggctgggtgtgccctcagccctggccagcatgaggaatctgagagcttactgtatcatgccccaactcactgcactgccagccgtctgagtcttgtatatgtctttgtctcagaacctgccttttgtgttcctgtccctgaaatctgtaccctgatttatatgatcataattgatctaatggaatgctccagaaccctaccctcagaactgtataattagtccttgaatttggaattttcatgctttttctctgctggaaacctttagacgtctgcaractcccagggcttactctataagtgcaattctgcttctgactcttccctccactgagatgcctgtacttctagggtgttccttgatctcctctaaattgttgatcccaaataggttgatcccagaaactgcttcttcagttgcaaaactgcagaaagcaacacaataaaaaaacaaaatcaaaataactcacatatttttaaaaatatgtaataaacattactgaatgttgtggagacattgggttgtgtgttatttaatcataagaatgcaaactactgaagattgaataggagtcatt

SEQ ID NO: 7823 - DNA, 601 bp, Human
tgatcccaaataggttgatcccagaaactgcttcttcagttgcaaaactgcagaaagcaacacaataaaaaaacaaaatcaaaataactcacatatttttaaaaatatgtaataaacattactgaatgttgtggagacattgggttgtgtgttatttaatcataagaatgcaaactactgaagattgaataggagtcattctagttctttttttttttttttttttccgagacagattctcgctgtgtcacccagactggagtgcagtggtgtgatctcagctcactgcaacctccacccsccggattcaaacgaatctcctgcctcagcctcctgagtagcagggactacaggcgcccatcatcacacctggctaatttttgtatttttagtagagactgggttggccaggctggtctgaaactcctgacctcaggcgatccacccgcctcagcctcccaaagtgctgggattacaggcatgagccaccacgcctgacccattcttaaaactcccaatgctttgttatgtacttcagcctctcttctttatcctgtttgatcccctccttctcatcacatttctgtttttttatttcact

SEQ ID NO: 7824 - DNA, 601 bp, Human
tcagcctctcttctttatcctgtttgatcccctccttctcatcacatttctgtttttttatttcactttcaaataatgttcatttttcacaaggagtttagttattatttctgtcatctcattttttgcccatccatggcctctaaaatcttggcttgtaccccaagtgttgatgtactcagatattaaggacacagacatatatgcatgtgtctgtatgtatatatgtagttttttacattctggtttattatgtatatgtatacatagaagacccagagagggtctctctctctctctmtatatatatatatgcatatgtttatatatcctcctatatattatttatgcttgtatagccaatcaaaatacatatattttacccatttatatttggtatatgtatatattttgattgcctgtacaaacataatatatatacacatatttatatatgtatacatacatatttgataccctaattttatacacatacgccatacatatgtgaatatgtaagtatgtgcacaaacatacatatatatgtgtgtttgtatatatgtgtgagtctaaatgttatacacagggacatacatgcgta

SEQ ID NO: 7825 - DNA, 601 bp, Human
gattaataattgaggatagcggtaactgtagagcgtagaggataaagacactcataactttaagagcagaggtagtgatgttactgataaacagttgacaagccaaccaaaatgaagacgtggagtcagaaaggccaagaaaacttggaggggaggggatcctcttagtcatccaactaaactatggccaactttgactcatccttttcatttgctctcatatcctgccaatattgctaatgtttttacttaattttctgctgaatttagttctattgctagtgacttagcttagccttcrtttcccttgacaaggaatattagtaatagtaaagttcttatcacacctcatgcttcattcaggctgtcttcccttctgtctatcctgtataccaccacttggtgaatcaccgtaagtgacattttgtcaagtatctgtgcttttcaaattcacttcaaagatcattctaaccatttatactggccacttattctgtacccctgctttgattcacttcatgaacacacattgagggtatatactataggtatcaaatctaaattttggcttctaatctacttggccattaagacattctag

SEQ ID NO: 7826 - DNA, 601 bp, Human
gtgagggctcattttcagcttcctggatggcaactgtatcctcacatgttggaaggggtaaacaggctcccccaagcctcttttataagggcactaatcccactaatgagcctggagtgctcatgacctaatcacctcctgcaggcccacccaccttcttaatactgtcacgttggggattaggttccaaaatatgggtcaatatttatatcatagcagccggtctactagctgaccttggcaaagggaaacctcacatcagtgggacggggatattgaagcctttgtcctttgggaaatytagcttccaaacctggtctgagatttaaaggcaagagtcacatctaagaaggtggaaaagtctggtacagctagactgagagtatcaggggaatttaccagggcgtttttgggactctacgtgggtaaattctcaagctattttctaataacttctaaattgataaagatagagagctgcatgggggttgcaaatctcattttctttggaaaaggagtgctttgtctttccaagaatcacatttcctggcaaataagaaactatattttgtaatagaagtcattctcctgtctactctaa

SEQ ID NO: 7827 - DNA, 601 bp, Human
acggcaaggtattaactgtaaattcatgacttagtcaatggggtagagtaaggagccaaaatcagaaaatgaaaacgtggtaaatgcatttcctaattgttcattactgctttttcaaagctatcattttctgctgagcaaaatagttagacaaaactagttatttttataaacaaagtgacttggccatttaagcagtttcctctccaaaatacaaaagacaagttatagactattttcttttctttcctgggcaacaccattagttatatgagctctaagagctgtcttgacatggaartaattcacttgcttcaagaaagaaagtatttgatttgttaactatgtgctcgagagacttctctcagttgcctgtttggataattttaagccttgaaattaatgctacattagaaatacaaatgagtaagagtagtatctacctatatttgagtatagtatgctggaaaatattttcatacatatgaattcattcactttttataataacttttaagagatagtcaaaacaattatcctccaactattgtgctaagtaagcctgaggagaaattcctcccaccccaaatcaatagaaggg

SEQ ID NO: 7828 - DNA, 601 bp, Human
ttctggatattgtggtctttcaatatttcaaatatccctgttaatacaccagttgttgccaggcgctgtggctcatgcctgtagtcccagcacttagggaggccgaggcaggtggatcacctgaggtcacgagttcgagaccagcctggccaacatgggtgaaaccctgtctctactaaaaatacaaaaattagctgggcatggtggtgggtgcctgtaatcccagctacttgggaggctgagacaggataattgcttgaaaccgggaggtggaggttgcagtgagctgagatcacaccaytgtactccagcctgggtgacaagagtgaaactccatctttccatctataaaaaaacaaaaacaaaaaacaccacaaaaacagatgttgtattttaagacctatgagtggcaatgcgctgatcttttattaaaagatagtacagtctttactgaatttaacaatcttttccttgggaaaactaagcaggcaggtttgggtaggatgaaaatgcagaggcagaatgctctggaaaatgcttgggaattggaattaaaaaacaaagctgtttgatctttctccgctattgttgctgcctgtgt

SEQ ID NO: 7829 - DNA, 601 bp, Human
aatacagctaacatttatttagaattgctacatccttcttgtgtggtgttaaattctcccaataaacaaatagcaggataaatcatcttaccattctaaagataaaagcatgagcctcaaaaagattaaataaaatgtttaagatcacatgttgtctgaaataaaaactgtgcaatcagtcactttgttattaagttacaccatttagtacagtgacactggctaacaaatgccccaagaagtattaaatctcttttctgaattttgaattatcacatgcattattaatctaccataattmaatgtcattttcatatgtgaaagtgtgagagggagaatgctgaggagattgaaggagaaagactatatgggttccaaaactggctcgattttgggaagttagttgatttgcttgtgcctctgtttcctcttatcatagtgttattattgagaaaactcccttgcaggtaataaatcctcaacagcaacttctttttgttatcagtattatcaggccattcccatgtcactatgattaaattatatactcctcaagggcaggaatagtatctgattttctgtaagattttctcttaggtct

SEQ ID NO: 7830 - DNA, 601 bp, Human
gttagttgatttgcttgtgcctctgtttcctcttatcatagtgttattattgagaaaactcccttgcaggtaataaatcctcaacagcaacttctttttgttatcagtattatcaggccattcccatgtcactatgattaaattatatactcctcaagggcaggaatagtatctgattttctgtaagattttctcttaggtctttgttgttattgcttcaagaatgcttcattacagaccaccacaacatttagtggcttacagaaaggcaacacaaatatatatgtgtgtgtgtgtgtgagtatgtatgtgtgtgtgtgtgtgtgtgtgtatatatatttctcactcttgggtgtgcaaatgagctacaactcagctaggcaagcctggacttcaggctgaaggctggctgcattctgctgcacgttatttttatgctacccaagctacgttttcggtattgtggatcacaggagcactagaaagtgagacgaaatacttgagatctcttaaatctttgactctgaaccaataacatgcactttatatccaaacatcactgggcaaaaggagccacaggcccaagccagatatctctgct

SEQ ID NO: 7831 - DNA, 601 bp, Human
gatttgcttgtgcctctgtttcctcttatcatagtgttattattgagaaaactcccttgcaggtaataaatcctcaacagcaacttctttttgttatcagtattatcaggccattcccatgtcactatgattaaattatatactcctcaagggcaggaatagtatctgattttctgtaagattttctcttaggtctttgttgttattgcttcaagaatgcttcattacagaccaccacaacatttagtggcttacagaaaggcaacacaaatatatatgtgtgtgtgtgtgtgtgtatgtrtgtgtgtgtgtgtgtgtgtgtgtatatatatttctcactcttgggtgtgcaaatgagctacaactcagctaggcaagcctggacttcaggctgaaggctggctgcattctgctgcacgttatttttatgctacccaagctacgttttcggtattgtggatcacaggagcactagaaagtgagacgaaatacttgagatctcttaaatctttgactctgaaccaataacatgcactttatatccaaacatcactgggcaaaaggagccacaggcccaagccagatatctctgctctgcatg

SEQ ID NO: 7832 - DNA, 601 bp, Human
atttgcttgtgcctctgtttcctcttatcatagtgttattattgagaaaactcccttgcaggtaataaatcctcaacagcaacttctttttgttatcagtattatcaggccattcccatgtcactatgattaaattatatactcctcaagggcaggaatagtatctgattttctgtaagattttctcttaggtctttgttgttattgcttcaagaatgcttcattacagaccaccacaacatttagtggcttacagaaaggcaacacaaatatatatgtgtgtgtgtgtgtgtgtatgtatgtgtgtgtgtgtgtgtgtgtgtatatatatttctcactcttgggtgtgcaaatgagctacaactcagctaggcaagcctggacttcaggctgaaggctggctgcattctgctgcacgttatttttatgctacccaagctacgttttcggtattgtggatcacaggagcactagaaagtgagacgaaatacttgagatctcttaaatctttgactctgaaccaataacatgcactttatatccaaacatcactgggcaaaaggagccacaggcccaagccagatatctctgctctgcatgg

SEQ ID NO: 7833 - DNA, 601 bp, Human
ccatattaatcaattacatagtaaattatattgacatcataagacattaggtctatgtttagggaattcatttttatgagattgatatgaactctcttatgtattaacttctggatgtatttttacttgtttaaaaattttcatgtcccttcacaaaaatccttaatttcctaaatatagacttaatgtcttatgagttaaagaacactgcactgaaatatatccaatatgccactttatggcaccttccaaatgctcttagtgtaaatgtatgttacaaatcccataaagcacagcaaarataacaaccaaactgttggtacaaatcatgagacagattcagtagttgtctgtttttatatgcacattcagtaagctgcttacctatgttttgttacattactttaattttcgtgcgttttctaccttaaaataatattttatgtaggataatatgcttagatctttgaataagctacttttagaatttcttgagaacttcaagagtattggaagcagtcaacatattattattcagatttctgttttgggggtttttaaaccatataactcaacttacttgagaagaaaggaaaacgta

SEQ ID NO: 7834 - DNA, 601 bp, Human
gaactttaattcctttaggaactaatatttccataaagtttcatcaattttgaaatttaatatacattttgatttgatgtccatatttgtataaatatatttgacaaacatatttatccatatcaaatgaacacaatctttaagaattaaaactctaaaaatggactgctttctcatatatagagtcaaggatttatatattgatatataaattaagagttgtatatatttatgttgtgtgtataattatgttgttcaatcaacagttatttattaaggaactactatttataagatgctrtatttgtagctgcagaggttataaagattaaaatgtgattcttgagagggaagtggaacaagatagccaactagaaccctccaatgatcatccaccccacagaaacaccaaactgaacaattatccatgcaggaaagcacctttatgagaaccaaaaaccagatgagtgatcacagtacccggtttcaataccatatcaaagaaaggaggcaatgaagaggtaggaaagacagtcttgaatcaccacaccatgcctaccccatccgccggcagcagccatgtagtgtggagagatcatct

SEQ ID NO: 7835 - DNA, 601 bp, Human
ctaatatttccataaagtttcatcaattttgaaatttaatatacattttgatttgatgtccatatttgtataaatatatttgacaaacatatttatccatatcaaatgaacacaatctttaagaattaaaactctaaaaatggactgctttctcatatatagagtcaaggatttatatattgatatataaattaagagttgtatatatttatgttgtgtgtataattatgttgttcaatcaacagttatttattaaggaactactatttataagatgctatatttgtagctgcagaggttrtaaagattaaaatgtgattcttgagagggaagtggaacaagatagccaactagaaccctccaatgatcatccaccccacagaaacaccaaactgaacaattatccatgcaggaaagcacctttatgagaaccaaaaaccagatgagtgatcacagtacccggtttcaataccatatcaaagaaaggaggcaatgaagaggtaggaaagacagtcttgaatcaccacaccatgcctaccccatccgccggcagcagccatgtagtgtggagagatcatctctgtgctgttgagggagaggg

SEQ ID NO: 7836 - DNA, 601 bp, Human
ggtgagacaccagccagggcagccaagggagtgtgtgcatcacccctcctttgaccctaggcagtgcagctcatagctccaggaggagagggtaaagaggaatttgtcttacaacttgcataccagctcagccacaataaaatagtgtaccagagcccccattcgaggcactagctccttgtgccagaaggaaacccactaccttgaagagaaggacccagtgctggcagaattcatcacctggctaaagagcacctgggttttgaataaatatcagtggtacccaggcagtacttgctgkgggccatgggtgagacccagggccatgctagattcaggtgtgatccaacatatttcaagctgtgttggccatggagagagatttcttttgcttgaagaaaggagaaagaaaagtaaaggggactttgtcttacagcttgggcaacagcttggcccagtgggttagaggatcaagtgaatccctggggtccccagttctacagttctaggccttgactcctggatggcatttctggacccacactgggccagagggaagcccactgccctgaagggagagaccaaggcctggtagcattca

SEQ ID NO: 7837 - DNA, 601 bp, Human
gtacccaggcagtacttgctgtgggccatgggtgagacccagggccatgctagattcaggtgtgatccaacatatttcaagctgtgttggccatggagagagatttcttttgcttgaagaaaggagaaagaaaagtaaaggggactttgtcttacagcttgggcaacagcttggcccagtgggttagaggatcaagtgaatccctggggtccccagttctacagttctaggccttgactcctggatggcatttctggacccacactgggccagagggaagcccactgccctgaagggagasaccaaggcctggtagcattcaccacaagctgagccttgagtgaacattggtaccaagcctggggtggtaatggccatggatagacactctttctgactgaggaaaggagagggaagggtgggaagaactttgttttgcagcttgggtgccaactcaagtcacagcagaacagtgcactaagtagattattaagtttcctgactccacgcactggctcatggacagcatttctgggccagccttgagccagggagtagcttgctgccctgaagggaggaacacaatcctggctcagtttgc

SEQ ID NO: 7838 - DNA, 601 bp, Human
gctcagtttgcaacctgctgactgaagagcccctgggccttgaacaaaattggcagtagccaggcagtgtggttgctatgagccttgggtgagacctagtaccatgctggctttgggactgacccagagtagtcccagtagtagttgcaacaggggtgcttgtgttacccctcccccagttccaggcagatcagtgtgaaaagagagactacatttgtttggaggaaagtaagggaagagaacatgagtctgcctggtaattcaaggaattctcctggatcttatccaggaccaccaaggrgatacctttacaagtctgtaagaatcacggcattactgggcttggggtgccccctaatgcagacacagctgcaatgaccaaagatttagataacaacactcaattccctttgaatgcttggaaatcccttctaagaaggacagatacaaataagcctggacagtgaagacaacaataaatacctaactctttaatgcttagacatcagtgaatatccacaagcatcaaggccatccaggaaaacatgacctcaccaaacaaactgaataaggcaccagggaccaatcctggagtgacaga

SEQ ID NO: 7839 - DNA, 601 bp, Human
ggaattctcctggatcttatccaggaccaccaaggagatacctttacaagtctgtaagaatcacggcattactgggcttggggtgccccctaatgcagacacagctgcaatgaccaaagatttagataacaacactcaattccctttgaatgcttggaaatcccttctaagaaggacagatacaaataagcctggacagtgaagacaacaataaatacctaactctttaatgcttagacatcagtgaatatccacaagcatcaaggccatccaggaaaacatgacctcaccaaacaaactraataaggcaccagggaccaatcctggagtgacagagttatgtgacctgtcaaagataatttaaaatacctgttttggggaagatcagtgaaattcaggataacacagagaaggaattcagaattctatcagataaatttagcaaagagattgaaataattaaaaaaagcagaaattctggagctgaaaaattcagttgacatactgaagaatgcatcagtatctatcaaccacagaattgatcaaacagaagaaagaattagtgagtttgaagacaggctatttgaatagttagaagaga

SEQ ID NO: 7840 - DNA, 601 bp, Human
aggaccaccaaggagatacctttacaagtctgtaagaatcacggcattactgggcttggggtgccccctaatgcagacacagctgcaatgaccaaagatttagataacaacactcaattccctttgaatgcttggaaatcccttctaagaaggacagatacaaataagcctggacagtgaagacaacaataaatacctaactctttaatgcttagacatcagtgaatatccacaagcatcaaggccatccaggaaaacatgacctcaccaaacaaactgaataaggcaccagggaccaatyctggagtgacagagttatgtgacctgtcaaagataatttaaaatacctgttttggggaagatcagtgaaattcaggataacacagagaaggaattcagaattctatcagataaatttagcaaagagattgaaataattaaaaaaagcagaaattctggagctgaaaaattcagttgacatactgaagaatgcatcagtatctatcaaccacagaattgatcaaacagaagaaagaattagtgagtttgaagacaggctatttgaatagttagaagagacaaaagacaaaaagaatgaagt

SEQ ID NO: 7841 - DNA, 601 bp, Human
acagtgaagacaacaataaatacctaactctttaatgcttagacatcagtgaatatccacaagcatcaaggccatccaggaaaacatgacctcaccaaacaaactgaataaggcaccagggaccaatcctggagtgacagagttatgtgacctgtcaaagataatttaaaatacctgttttggggaagatcagtgaaattcaggataacacagagaaggaattcagaattctatcagataaatttagcaaagagattgaaataattaaaaaaagcagaaattctggagctgaaaaattcarttgacatactgaagaatgcatcagtatctatcaaccacagaattgatcaaacagaagaaagaattagtgagtttgaagacaggctatttgaatagttagaagagacaaaagacaaaaagaatgaagtttgcttacaagacccagaaaatagcctcaaaagggtaaatctaagagctatttgtcttaaggagaagggggagagagagatcagcatagaaaatttattcaaagggatagccgagaaatttccaaacctagagaaatatgtcaatactcaagtacaagaaggttatagaacac

SEQ ID NO: 7842 - DNA, 601 bp, Human
aacaaactgaataaggcaccagggaccaatcctggagtgacagagttatgtgacctgtcaaagataatttaaaatacctgttttggggaagatcagtgaaattcaggataacacagagaaggaattcagaattctatcagataaatttagcaaagagattgaaataattaaaaaaagcagaaattctggagctgaaaaattcagttgacatactgaagaatgcatcagtatctatcaaccacagaattgatcaaacagaagaaagaattagtgagtttgaagacaggctatttgaatagtyagaagagacaaaagacaaaaagaatgaagtttgcttacaagacccagaaaatagcctcaaaagggtaaatctaagagctatttgtcttaaggagaagggggagagagagatcagcatagaaaatttattcaaagggatagccgagaaatttccaaacctagagaaatatgtcaatactcaagtacaagaaggttatagaacaccaaatagatttaacccaaataaaactacctcaaggaattcaatagtcaaattcccaaaggtccaggataaagaaaagattcttaaattagcaagaga

SEQ ID NO: 7843 - DNA, 601 bp, Human
agagttttcattagttttctctttgcttgttagttcatttttgcaatcagtgttgtcatcagtttaaaataatgaattataagatattatttgcaagcttcatagtaacctcaattccaaaaactgacagataaaaagtttaaaaatgaaattaaaacataccatcagaaaaaataatcttcacaaaaaggaagacaagaaggaaggcaagaaagaaggaaagatgacaaaacaaccagaaaacaagtaacaaaatggcaagattaagtctttacttattaataataatattgaatataartggactaaactctctaatcaaaagacatggagtgacttactggattcaaaaactaaacaaaacaaatgagacccaatgaacatttgcccacaactaacacacttcatctgtaagacacaaatagactgaaaataaagggatgaaaaaacatattccatacaaacagaaaccaaagaagagcaggaatagctatacttatgtcagacaatatagatttcaagacaaaaactatataagaggcaagtttattatgtaatgataaaggagtcaactcagcaagaagttatagcaagtgtaaat

SEQ ID NO: 7844 - DNA, 601 bp, Human
gacatggagtgacttactggattcaaaaactaaacaaaacaaatgagacccaatgaacatttgcccacaactaacacacttcatctgtaagacacaaatagactgaaaataaagggatgaaaaaacatattccatacaaacagaaaccaaagaagagcaggaatagctatacttatgtcagacaatatagatttcaagacaaaaactatataagaggcaagtttattatgtaatgataaaggagtcaactcagcaagaagttatagcaagtgtaaatatatatacacccaaaactggagcrcctagacatgtaaagcaaatattattagagctaaagtgagagatagaccccaatacaataagagctaaagactttaacaccccactttcagcattggacagatcatctagacagaaaatcaacaaagaaacatcagacataatctgcactacagaccaattgaacctgataggtatttccaagaacatcgatggctgcaaagtgcacatgcttctcctctgcacatggatcattctcaagggtagactatatgttaggccacaaaacaagtattaaagaattcaaaaatattgaaattat

SEQ ID NO: 7845 - DNA, 601 bp, Human
caaatattattagagctaaagtgagagatagaccccaatacaataagagctaaagactttaacaccccactttcagcattggacagatcatctagacagaaaatcaacaaagaaacatcagacataatctgcactacagaccaattgaacctgataggtatttccaagaacatcgatggctgcaaagtgcacatgcttctcctctgcacatggatcattctcaagggtagactatatgttaggccacaaaacaagtattaaagaattcaaaaatattgaaattatatcacatatcttctcrgaccacaatggaataaaactagaaatcaataacaagaggaactttggaaactatgcagacacacagaaattaaacaatatgctcctgaatgaccaatgggtcaatgaagtaattaagaaataaatttaaaaatttcttaaaacaaatggaaagactacatacccaaacctatggaatacaatgaaaacaatactaagaggaaagtttatagtaataaggacctacatcaaaaaagtacaaaaacttcaaataaacaacctagtggtgcatgttaaagaattagaaaagcaagaacaaacc

SEQ ID NO: 7846 - DNA, 601 bp, Human
tagacagaaaatcaacaaagaaacatcagacataatctgcactacagaccaattgaacctgataggtatttccaagaacatcgatggctgcaaagtgcacatgcttctcctctgcacatggatcattctcaagggtagactatatgttaggccacaaaacaagtattaaagaattcaaaaatattgaaattatatcacatatcttctcagaccacaatggaataaaactagaaatcaataacaagaggaactttggaaactatgcagacacacagaaattaaacaatatgctcctgaatgrccaatgggtcaatgaagtaattaagaaataaatttaaaaatttcttaaaacaaatggaaagactacatacccaaacctatggaatacaatgaaaacaatactaagaggaaagtttatagtaataaggacctacatcaaaaaagtacaaaaacttcaaataaacaacctagtggtgcatgttaaagaattagaaaagcaagaacaaaccaaaccccaaattactggaagaaaatagtgaagatcatagccgaaataaatgagatcaaattaaaaaaataacaaaagatcaaccaaagggaa

SEQ ID NO: 7847 - DNA, 601 bp, Human
tctgcactacagaccaattgaacctgataggtatttccaagaacatcgatggctgcaaagtgcacatgcttctcctctgcacatggatcattctcaagggtagactatatgttaggccacaaaacaagtattaaagaattcaaaaatattgaaattatatcacatatcttctcagaccacaatggaataaaactagaaatcaataacaagaggaactttggaaactatgcagacacacagaaattaaacaatatgctcctgaatgaccaatgggtcaatgaagtaattaagaaataaattwaaaaatttcttaaaacaaatggaaagactacatacccaaacctatggaatacaatgaaaacaatactaagaggaaagtttatagtaataaggacctacatcaaaaaagtacaaaaacttcaaataaacaacctagtggtgcatgttaaagaattagaaaagcaagaacaaaccaaaccccaaattactggaagaaaatagtgaagatcatagccgaaataaatgagatcaaattaaaaaaataacaaaagatcaaccaaagggaaagttggtgttttgaaaagataaacaaaattgccaa

SEQ ID NO: 7848 - DNA, 601 bp, Human
accaattgaacctgataggtatttccaagaacatcgatggctgcaaagtgcacatgcttctcctctgcacatggatcattctcaagggtagactatatgttaggccacaaaacaagtattaaagaattcaaaaatattgaaattatatcacatatcttctcagaccacaatggaataaaactagaaatcaataacaagaggaactttggaaactatgcagacacacagaaattaaacaatatgctcctgaatgaccaatgggtcaatgaagtaattaagaaataaatttaaaaatttcttraaacaaatggaaagactacatacccaaacctatggaatacaatgaaaacaatactaagaggaaagtttatagtaataaggacctacatcaaaaaagtacaaaaacttcaaataaacaacctagtggtgcatgttaaagaattagaaaagcaagaacaaaccaaaccccaaattactggaagaaaatagtgaagatcatagccgaaataaatgagatcaaattaaaaaaataacaaaagatcaaccaaagggaaagttggtgttttgaaaagataaacaaaattgccaaacctttagccag

SEQ ID NO: 7849 - DNA, 601 bp, Human
taaaactagaaatcaataacaagaggaactttggaaactatgcagacacacagaaattaaacaatatgctcctgaatgaccaatgggtcaatgaagtaattaagaaataaatttaaaaatttcttaaaacaaatggaaagactacatacccaaacctatggaatacaatgaaaacaatactaagaggaaagtttatagtaataaggacctacatcaaaaaagtacaaaaacttcaaataaacaacctagtggtgcatgttaaagaattagaaaagcaagaacaaaccaaaccccaaattaytggaagaaaatagtgaagatcatagccgaaataaatgagatcaaattaaaaaaataacaaaagatcaaccaaagggaaagttggtgttttgaaaagataaacaaaattgccaaacctttagccagactaaaaaagaagagccaaataaataaaatcagagatgaaaaaggagacattacagctgatactacagaaattcaaaggatcatttgtgactactatgaacaactatatatatgccaataaattagaaaacctggaagaaatggataaattcctagacacatacaacctatcaag

SEQ ID NO: 7850 - DNA, 601 bp, Human
tatcagcagaatgaaggacaaagccatatgatcatttcagttgatactgaaaaagcattggataagtcactattacttcatgataaaaaccctcaaaaaactgggtatagaaggaacaaacttcaacacaataaaagccacatatgacagacctatggctagtatcatactgattggggaaaaactgaaaggctttccttgaagatcaagaacacgatacggatgcccacttttaccagtgttattcaacacagtactggaagtcctagtcagacaatcagataagaaaaagaaataatgktcatccacatgggaaaggaagaagtcaaattatccttgtttgcagatgatatgatcttatgcttagaaaaacccacagactccaccaaaaaactattagaactgataaattcagtaaagtttcaggatataaaatcaaaatataaaaatcaatagcacttctaaatgccaacagcaaacaatttgaaaaagaaataaagaaagtaacctcatttacaacagctacaaataaaatgagttaaccaaagaagagaaagatctctacaatgaaaactataaacattgatgcaaaaaattgaag

SEQ ID NO: 7851 - DNA, 601 bp, Human
actgaaaaagcattggataagtcactattacttcatgataaaaaccctcaaaaaactgggtatagaaggaacaaacttcaacacaataaaagccacatatgacagacctatggctagtatcatactgattggggaaaaactgaaaggctttccttgaagatcaagaacacgatacggatgcccacttttaccagtgttattcaacacagtactggaagtcctagtcagacaatcagataagaaaaagaaataatgttcatccacatgggaaaggaagaagtcaaattatccttgtttgcaratgatatgatcttatgcttagaaaaacccacagactccaccaaaaaactattagaactgataaattcagtaaagtttcaggatataaaatcaaaatataaaaatcaatagcacttctaaatgccaacagcaaacaatttgaaaaagaaataaagaaagtaacctcatttacaacagctacaaataaaatgagttaaccaaagaagagaaagatctctacaatgaaaactataaacattgatgcaaaaaattgaagaggactcaaaaaatggaaagagatttcatgttcatggattagaag

SEQ ID NO: 7852 - DNA, 601 bp, Human
aaactgaaaggctttccttgaagatcaagaacacgatacggatgcccacttttaccagtgttattcaacacagtactggaagtcctagtcagacaatcagataagaaaaagaaataatgttcatccacatgggaaaggaagaagtcaaattatccttgtttgcagatgatatgatcttatgcttagaaaaacccacagactccaccaaaaaactattagaactgataaattcagtaaagtttcaggatataaaatcaaaatataaaaatcaatagcacttctaaatgccaacagcaaacartttgaaaaagaaataaagaaagtaacctcatttacaacagctacaaataaaatgagttaaccaaagaagagaaagatctctacaatgaaaactataaacattgatgcaaaaaattgaagaggactcaaaaaatggaaagagatttcatgttcatggattagaagactcaatattgttaaagcatccatactacccaaagcaatctacagataaaatgtaatctctatcaaaataccaatgacattcttcacaagaatagaaaaagtaatcttaaaatttattgaactacaaaatacccag

SEQ ID NO: 7853 - DNA, 601 bp, Human
ccttgaagatcaagaacacgatacggatgcccacttttaccagtgttattcaacacagtactggaagtcctagtcagacaatcagataagaaaaagaaataatgttcatccacatgggaaaggaagaagtcaaattatccttgtttgcagatgatatgatcttatgcttagaaaaacccacagactccaccaaaaaactattagaactgataaattcagtaaagtttcaggatataaaatcaaaatataaaaatcaatagcacttctaaatgccaacagcaaacaatttgaaaaagaaatmaagaaagtaacctcatttacaacagctacaaataaaatgagttaaccaaagaagagaaagatctctacaatgaaaactataaacattgatgcaaaaaattgaagaggactcaaaaaatggaaagagatttcatgttcatggattagaagactcaatattgttaaagcatccatactacccaaagcaatctacagataaaatgtaatctctatcaaaataccaatgacattcttcacaagaatagaaaaagtaatcttaaaatttattgaactacaaaatacccagaataaccaaagccat

SEQ ID NO: 7854 - DNA, 601 bp, Human
cccacttttaccagtgttattcaacacagtactggaagtcctagtcagacaatcagataagaaaaagaaataatgttcatccacatgggaaaggaagaagtcaaattatccttgtttgcagatgatatgatcttatgcttagaaaaacccacagactccaccaaaaaactattagaactgataaattcagtaaagtttcaggatataaaatcaaaatataaaaatcaatagcacttctaaatgccaacagcaaacaatttgaaaaagaaataaagaaagtaacctcatttacaacagctayaaataaaatgagttaaccaaagaagagaaagatctctacaatgaaaactataaacattgatgcaaaaaattgaagaggactcaaaaaatggaaagagatttcatgttcatggattagaagactcaatattgttaaagcatccatactacccaaagcaatctacagataaaatgtaatctctatcaaaataccaatgacattcttcacaagaatagaaaaagtaatcttaaaatttattgaactacaaaatacccagaataaccaaagccatcttgagcaaaaagaacaaaactggaggca

SEQ ID NO: 7855 - DNA, 601 bp, Human
actagcataaaaacagacatatagactgaaggaatagaatagagaacacataaataaatccatacatctacagtgacctcatttttttataaaggtgccaagaacatacattgaggaaaacacaatctcttcaataaatggctctgggaaaactgatatccatatgcagaagaataaaactagacccttatctctcaccacatacaaaaatcaaatcaaaatgtattaaagacttaaatctaagacctcaaactaggaaactactaaaagaaacagttgaggaaactctctaggacatcgstctgggcaaagatttcttgagtaataccccacaagcacaggcaaccaaagcaaaaatggacaaatgggatcacatcaagtgaaaaagcttctgcacagcaaaggcaacaatcaacaaagtgaagagacaacccacagaataggataaaatatttgcaaactattcatttgacaagagattaatatcaagaatatataagaagcccacacaactcaacaggaaaaaaaaaatctaaaaatccaatcaaaatgggccaaagatctgaatggatattttttgaagacatacaaatagcaaaca

SEQ ID NO: 7856 - DNA, 601 bp, Human
aataccccatttaccctgatgtgattattacacattctatgcctgtatccaagtatctcacaccctgtaaatatatacatctaccatgtacccataaaaagtaagaataaaaaaataaattcagagtaaaaaatcatatgattttgtccttgagaaacttagtagtaggtttatagtatagcataatgcagtattagagaagtacaaagtgctttatatgtgaggagttggggttgttttgaaaatgagcatgatgttgactggtgggtatgaaaagaattgcattgtagtcaaacaagcraaattttaaggtaggatatcatggacattttgcttgcctaggccagcaggttcttttaaagaagctgttggagagaaaccttcagagatcaataggagcagctcatagggagccttttaatgccaaaagatatgtgtgtgtgtgtgtgtgtgtgtatgtgtgtgtactcatatatgtgtaactatatacacacacatgcatatatatacacacacacgcatatatatatatacacacacgtgcatgtatatacacacatatatatacacatgtgcatatatatatgtatatatatatata

SEQ ID NO: 7857 - DNA, 601 bp, Human
cctgtaaatatatacatctaccatgtacccataaaaagtaagaataaaaaaataaattcagagtaaaaaatcatatgattttgtccttgagaaacttagtagtaggtttatagtatagcataatgcagtattagagaagtacaaagtgctttatatgtgaggagttggggttgttttgaaaatgagcatgatgttgactggtgggtatgaaaagaattgcattgtagtcaaacaagcgaaattttaaggtaggatatcatggacattttgcttgcctaggccagcaggttcttttaaagawgctgttggagagaaaccttcagagatcaataggagcagctcatagggagccttttaatgccaaaagatatgtgtgtgtgtgtgtgtgtgtgtatgtgtgtgtactcatatatgtgtaactatatacacacacatgcatatatatacacacacacgcatatatatatatacacacacgtgcatgtatatacacacatatatatacacatgtgcatatatatatgtatatatatatatatgagagagagcatatatatacatatgagagagagagagagagactgtgaacgcccttggcagg

SEQ ID NO: 7858 - DNA, 601 bp, Human
acatctaccatgtacccataaaaagtaagaataaaaaaataaattcagagtaaaaaatcatatgattttgtccttgagaaacttagtagtaggtttatagtatagcataatgcagtattagagaagtacaaagtgctttatatgtgaggagttggggttgttttgaaaatgagcatgatgttgactggtgggtatgaaaagaattgcattgtagtcaaacaagcgaaattttaaggtaggatatcatggacattttgcttgcctaggccagcaggttcttttaaagaagctgttggagagraaccttcagagatcaataggagcagctcatagggagccttttaatgccaaaagatatgtgtgtgtgtgtgtgtgtgtgtatgtgtgtgtactcatatatgtgtaactatatacacacacatgcatatatatacacacacacgcatatatatatatacacacacgtgcatgtatatacacacatatatatacacatgtgcatatatatatgtatatatatatatatgagagagagcatatatatacatatgagagagagagagagagactgtgaacgcccttggcaggcaatgtgagcaga

SEQ ID NO: 7859 - DNA, 601 bp, Human
gaaaagaattgcattgtagtcaaacaagcgaaattttaaggtaggatatcatggacattttgcttgcctaggccagcaggttcttttaaagaagctgttggagagaaaccttcagagatcaataggagcagctcatagggagccttttaatgccaaaagatatgtgtgtgtgtgtgtgtgtgtgtatgtgtgtgtactcatatatgtgtaactatatacacacacatgcatatatatacacacacacgcatatatatatatacacacacgtgcatgtatatacacacatatatatacacawgtgcatatatatatgtatatatatatatatgagagagagcatatatatacatatgagagagagagagagagactgtgaacgcccttggcaggcaatgtgagcagagaattggcttttccagaaaggagtttctgggacatcactcttgggataaataggaaaaagataaaagccttcaaatggaggtaccaaggagaaagctatttagctattttaatagctaatagtgaaattaataatattctaaaattttgtgggtggctataggaagaaaagggaaagaatgatgctaggcacatt

SEQ ID NO: 7860 - DNA, 601 bp, Human
agctgttggagagaaaccttcagagatcaataggagcagctcatagggagccttttaatgccaaaagatatgtgtgtgtgtgtgtgtgtgtgtatgtgtgtgtactcatatatgtgtaactatatacacacacatgcatatatatacacacacacgcatatatatatatacacacacgtgcatgtatatacacacatatatatacacatgtgcatatatatatgtatatatatatatatgagagagagcatatatatacatatgagagagagagagagagactgtgaacgcccttggcagkcaatgtgagcagagaattggcttttccagaaaggagtttctgggacatcactcttgggataaataggaaaaagataaaagccttcaaatggaggtaccaaggagaaagctatttagctattttaatagctaatagtgaaattaataatattctaaaattttgtgggtggctataggaagaaaagggaaagaatgatgctaggcacattgtgatattatagaactgacaggaattggagactgggttaagaggtggagatggggctgcaatttggtaaatgtaactagttatggacttctg

SEQ ID NO: 7861 - DNA, 552 bp, Human
tgaacgcccttggcaggcaatgtgagcagagaattggcttttccagaaaggagtttctgggacatcactcttgggataaataggaaaaagataaaagccttcaaatggaggtaccaaggagaaagctatttagctattttaatagctaatagtgaaattaataatattctaaaattttgtgggtggctataggaagaaaagggaaagaatgatgctaggcacattgtgatattatagaactgacaggaattggagactgggttaagaggtggagatggggctgcaatttggtaaatgtaastagttatggacttctggctctcaaatattgcaagttctacaacccttcctccaccgtatcccagagatatctgagtgtctttttggtttgaatttcaagttaaaaccctgaatatctggaggaacacccacgcccatcatgctctgatgttaagtactaataccttttgctcatccttggttaaatctttttaaattcattcattgttctctctatatatactcctcactaacatgcaagatttttctttt

SEQ ID NO: 7862 - DNA, 551 bp, Human
gaacgcccttggcaggcaatgtgagcagagaattggcttttccagaaaggagtttctgggacatcactcttgggataaataggaaaaagataaaagccttcaaatggaggtaccaaggagaaagctatttagctattttaatagctaatagtgaaattaataatattctaaaattttgtgggtggctataggaagaaaagggaaagaatgatgctaggcacattgtgatattatagaactgacaggaattggagactgggttaagaggtggagatggggctgcaatttggtaaatgtaacyagttatggacttctggctctcaaatattgcaagttctacaacccttcctccaccgtatcccagagatatctgagtgtctttttggtttgaatttcaagttaaaaccctgaatatctggaggaacacccacgcccatcatgctctgatgttaagtactaataccttttgctcatccttggttaaatctttttaaattcattcattgttctctctatatatactcctcactaacatgcaagatttttctttt

SEQ ID NO: 7863 - DNA, 496 bp, Human
ctgggacatcactcttgggataaataggaaaaagataaaagccttcaaatggaggtaccaaggagaaagctatttagctattttaatagctaatagtgaaattaataatattctaaaattttgtgggtggctataggaagaaaagggaaagaatgatgctaggcacattgtgatattatagaactgacaggaattggagactgggttaagaggtggagatggggctgcaatttggtaaatgtaactagttatggacttctggctctcaaatattgcaagttctacaacccttcctccaccktatcccagagatatctgagtgtctttttggtttgaatttcaagttaaaaccctgaatatctggaggaacacccacgcccatcatgctctgatgttaagtactaataccttttgctcatccttggttaaatctttttaaattcattcattgttctctctatatatactcctcactaacatgcaagatttttctttt

SEQ ID NO: 7864 - DNA, 601 bp, Human
agtgggggccaaagaagacatcaactcccaaagattaccagtttattacgtaatgagcatgtattagccgagaaggcttgaaaaagttgacttttgaatgcgacacattttctttaaaatattgaatctggatgtttttctagttatttaaatttttatttgtaggtatctgtctagggcactttgaccctttaggtgtgggttagccatttctcattaggactgggaaagatgagtgagaaataaaattatagattgcatgttaaaaagaaaaacactggttgtgacactgagtataggtttttttttttactatatctgaagtaaaatgatacttatctgccttgttaattatatttatttgtaaaaatagtttccatttaaatttgtcaataataaaattcctcatgaaaaatatcagaaacctactctcttttataatgaaaagaaacctaagtattagttttttatgtacctatgacatttgattacaatatggaatgaaatttaattgtagcatagtatgaaatggaaaacaccctaaatataccatgaaatttatgttatgctgtgtaataatttcctcatatactttccatat

SEQ ID NO: 7865 - DNA, 601 bp, Human
atttgattacaatatggaatgaaatttaattgtagcatagtatgaaatggaaaacaccctaaatataccatgaaatttatgttatgctgtgtaataatttcctcatatactttccatatataggcactaaataaagtgaagtaatttaggttaatttaggaggcagatgtttttcaaatactcataggtgtatcaggtaggatacacctgattgtgacattatttggggtccgtataatagaaaacccaagccaagggtgtgtaaggaaaaaaattgcaatttactggaccacttaactgwagtagttaggactgtgatttccaaagtgtgattcttgaatcagcagcacacgcatcaacgggggacttgttaaaactgtgaattctcagtttcatactcacggcatcagagactctggctgtggagctcaacagcctgtgtattaacaagtcctccagcttccgatgcttccatagtcaagtttaagaaacactggtatagagctggatctatccctgggtgcaaatcaacttacggttcaaaggataccaccaggatctaaaggtggactctgctaggcactgggatagccccacaccc

SEQ ID NO: 7866 - DNA, 601 bp, Human
tgaagtagttaggactgtgatttccaaagtgtgattcttgaatcagcagcacacgcatcaacgggggacttgttaaaactgtgaattctcagtttcatactcacggcatcagagactctggctgtggagctcaacagcctgtgtattaacaagtcctccagcttccgatgcttccatagtcaagtttaagaaacactggtatagagctggatctatccctgggtgcaaatcaacttacggttcaaaggataccaccaggatctaaaggtggactctgctaggcactgggatagccccacayccaggcttcacatggtggctaatgacaacagtagatacatatcatcacagcaccctgtccagtggacagagaaattatctcacctggaatcctcttgatgttcctgggtagcctgactcagggagtatctctgtccttcagccaatcacaatgctgagtgaatgggatgttccagttgtcttattctagtcatattgtccactgtcaaggttgcaattaatttagtatgggggcattgccacaagaaggacaagaagatgtagaatatcattgacaatgtgtcacaaacagcaaagattc

SEQ ID NO: 7867 - DNA, 601 bp, Human
ctatcttaccacatatttttgaaatctaatctgattgttatcacatatttctttaagtggaatggcttaaataactcagataattaaaggctaattaaaggctttgtcatcattaagataattaaagtatcaattagctttttaaaaggaagcttagccttaatcagaaatcctctattcacacagcagggcctcagatatggcagatattcctgaaatggaaaaacagtacttcaaagttgaggctctgtggaacttcgtcatgatttttcttcatcaatctctattcttttttgtagayggcatatttggttttttttttcccctgctttttgtctaactagttatatattgcttattgtagatacttttgcaaataccaaaaaaaatgaaactcccagaagcaacattttagctaatttttcccagcatttttctaagttttatttttatttttgtggttaaaagggataggtaaaaacccatcagcataaaaaatttacttctctaataccctaggaaaacaagagaattacaaaatacctagaactgaatgataatgatttctggtttcaaatatttcctgccatgaatttagttt

SEQ ID NO: 7868 - DNA, 601 bp, Human
tagaactgaatgataatgatttctggtttcaaatatttcctgccatgaatttagttttatttatcctatcagtgattatgtatagcttttctacatggtttatttaattcttaaaaattctcagtgatttttctattccaacattgtcaattgacccaagttgagtttctggatatgaaaaccacaatatttgatatgaaaaatactatatgggattaacagcagattcacatcacagaagaaaaaacggtgaatttgaagatggagcattcgaagctatccaaattaaaacagaaaaatrtttttatttgtataaattttaggattacaagtgcagttttgctacatgaatatgttgtatagcgggggaagtctgggtttttagtgtaatcatctcctaggactattcagaaaataggttttaaaaatgaatggaacatcagttagctgtgaaacaattttaaatgatctaatagaggtataatttaatttgtgaaggacaggaactggcaaaatatttgaagaaataataatgaaaatatttcaaatttgatgaacattgtatatccacaagcacaagacgctcaataaacttgaacta

SEQ ID NO: 7869 - DNA, 601 bp, Human
acaaaaataaggatgatagcagatttctcttatttcaaagacagtagaacaacatctttaaaggattgaagaaaaaatgtaaacctagaagtctaaactcagcaaaatacttttcaaaaacaaatgtgaaattaagacttttttcaggcttacaaaagagaatcatcactggtcgatgtcagctagaagaaatgctagaggaagttctgcaggcacaaggaaaatcatgccaagtggaaagatgaatctacactaagtcatgaaaagaactagaaatggtaattacatgggtaaatatatrtggtgcatttttcttttattcacatgtcttttaaagagaagtttgcatcaaaaagtgggtaaaggatatgaatagacagttctcaaaaaaagatatacaaacagctaacaaacatatgaaaaaatgctcaaaatcacgaatcatcagggaaatgcaaactaaaacctcagtgagatactaccttactcctataagaatggccgtaattaggccaggtgcggtggttcacgtcggtaatctcagcactttgggagaccgaggtgggctgatcacgaggtcaggagatcgagaccacagtga

SEQ ID NO: 7870 - DNA, 601 bp, Human
cagtagaacaacatctttaaaggattgaagaaaaaatgtaaacctagaagtctaaactcagcaaaatacttttcaaaaacaaatgtgaaattaagacttttttcaggcttacaaaagagaatcatcactggtcgatgtcagctagaagaaatgctagaggaagttctgcaggcacaaggaaaatcatgccaagtggaaagatgaatctacactaagtcatgaaaagaactagaaatggtaattacatgggtaaatatatgtggtgcatttttcttttattcacatgtcttttaaagagaartttgcatcaaaaagtgggtaaaggatatgaatagacagttctcaaaaaaagatatacaaacagctaacaaacatatgaaaaaatgctcaaaatcacgaatcatcagggaaatgcaaactaaaacctcagtgagatactaccttactcctataagaatggccgtaattaggccaggtgcggtggttcacgtcggtaatctcagcactttgggagaccgaggtgggctgatcacgaggtcaggagatcgagaccacagtgaaaccccgtctctactaaaaatacaaaaaattacctgggcgt

SEQ ID NO: 7871 - DNA, 601 bp, Human
actggtcgatgtcagctagaagaaatgctagaggaagttctgcaggcacaaggaaaatcatgccaagtggaaagatgaatctacactaagtcatgaaaagaactagaaatggtaattacatgggtaaatatatgtggtgcatttttcttttattcacatgtcttttaaagagaagtttgcatcaaaaagtgggtaaaggatatgaatagacagttctcaaaaaaagatatacaaacagctaacaaacatatgaaaaaatgctcaaaatcacgaatcatcagggaaatgcaaactaaaaccwcagtgagatactaccttactcctataagaatggccgtaattaggccaggtgcggtggttcacgtcggtaatctcagcactttgggagaccgaggtgggctgatcacgaggtcaggagatcgagaccacagtgaaaccccgtctctactaaaaatacaaaaaattacctgggcgtggtggcgggcgcccgtagtcccagctgcttgggaggctgaggcaggagaatggcgtgaacccgggaggcagagcttgcagtgagccaagatcacgccactgtactccagcctggtcaacagagcga

SEQ ID NO: 7872 - DNA, 601 bp, Human
tcaaaaagtgggtaaaggatatgaatagacagttctcaaaaaaagatatacaaacagctaacaaacatatgaaaaaatgctcaaaatcacgaatcatcagggaaatgcaaactaaaacctcagtgagatactaccttactcctataagaatggccgtaattaggccaggtgcggtggttcacgtcggtaatctcagcactttgggagaccgaggtgggctgatcacgaggtcaggagatcgagaccacagtgaaaccccgtctctactaaaaatacaaaaaattacctgggcgtggtggcrggcgcccgtagtcccagctgcttgggaggctgaggcaggagaatggcgtgaacccgggaggcagagcttgcagtgagccaagatcacgccactgtactccagcctggtcaacagagcgagactctgtctcaaaacaaaacaaaacaaaagaatggccataattaaaacatcaaaaaaacaatagatgttggtagggatgtggtgaaaagggcacacttttacactgctggtgagaatataaattagtgtaatacaaccagtatggaaaacagtgtggagatttcttaaaaaactaaaagt

SEQ ID NO: 7873 - DNA, 601 bp, Human
cctcagtgagatactaccttactcctataagaatggccgtaattaggccaggtgcggtggttcacgtcggtaatctcagcactttgggagaccgaggtgggctgatcacgaggtcaggagatcgagaccacagtgaaaccccgtctctactaaaaatacaaaaaattacctgggcgtggtggcgggcgcccgtagtcccagctgcttgggaggctgaggcaggagaatggcgtgaacccgggaggcagagcttgcagtgagccaagatcacgccactgtactccagcctggtcaacagagygagactctgtctcaaaacaaaacaaaacaaaagaatggccataattaaaacatcaaaaaaacaatagatgttggtagggatgtggtgaaaagggcacacttttacactgctggtgagaatataaattagtgtaatacaaccagtatggaaaacagtgtggagatttcttaaaaaactaaaagtagaactaccatcaatccagcaatcccactcctgggtatctacccaatggaaaagaaatcattagacgaaaaagataaacgcacacatgtgtttacagcagcaccattgcaaagatgt

SEQ ID NO: 7874 - DNA, 601 bp, Human
gaaccaacctaagtgtccatcaaccaacgagtggataaaaaaaaaatgtggtatatatacaccagggaatactactcagccttgaaaaggagtgaaataatgtcttctgaagcaacttggatggagctgggggccattattctaagtgaagtaactgaggaatcaaaaaccaaatatatgttctcacttataagtaggagctaagctatgagaatgcaaaggcataagaatgatataatggactttggggacttgggagagggaagggtgtgagatgggtgagggataaaagactacccaytgggtacagtgtacactgctcaggtgatgagtgcaccaaaatctcagaaatcaccactaaagaacttcacctgtttcccaaaactattgaaataaaaataaaaattagaaaagatcagagggaaagaatatgggggaaataagacccccatcaaaaaataagtgatgaaagatactggggaaaaacacaggagagcaggttactggggaaataaagactatttgagaaatgggcaaaaatgataaataatgcaaatccacaatgtaagtttcatattttaaaagtctagacctcttgcag

SEQ ID NO: 7875 - DNA, 601 bp, Human
cttgaaaaggagtgaaataatgtcttctgaagcaacttggatggagctgggggccattattctaagtgaagtaactgaggaatcaaaaaccaaatatatgttctcacttataagtaggagctaagctatgagaatgcaaaggcataagaatgatataatggactttggggacttgggagagggaagggtgtgagatgggtgagggataaaagactacccattgggtacagtgtacactgctcaggtgatgagtgcaccaaaatctcagaaatcaccactaaagaacttcacctgtttcccraaactattgaaataaaaataaaaattagaaaagatcagagggaaagaatatgggggaaataagacccccatcaaaaaataagtgatgaaagatactggggaaaaacacaggagagcaggttactggggaaataaagactatttgagaaatgggcaaaaatgataaataatgcaaatccacaatgtaagtttcatattttaaaagtctagacctcttgcagctttgaaacttcatgatgctatttaaatgtcatgtttagtattgtaaataatggtaattttaatcattaatgctaattgc

SEQ ID NO: 7876 - DNA, 601 bp, Human
atatgttctcacttataagtaggagctaagctatgagaatgcaaaggcataagaatgatataatggactttggggacttgggagagggaagggtgtgagatgggtgagggataaaagactacccattgggtacagtgtacactgctcaggtgatgagtgcaccaaaatctcagaaatcaccactaaagaacttcacctgtttcccaaaactattgaaataaaaataaaaattagaaaagatcagagggaaagaatatgggggaaataagacccccatcaaaaaataagtgatgaaagataytggggaaaaacacaggagagcaggttactggggaaataaagactatttgagaaatgggcaaaaatgataaataatgcaaatccacaatgtaagtttcatattttaaaagtctagacctcttgcagctttgaaacttcatgatgctatttaaatgtcatgtttagtattgtaaataatggtaattttaatcattaatgctaattgctattctctgtggctatattactattcatttattcagtcaatgcatgtttgtttagcactagaaggaacataagcacacatccagtagtctgtatt

SEQ ID NO: 7877 - DNA, 601 bp, Human
cttataagtaggagctaagctatgagaatgcaaaggcataagaatgatataatggactttggggacttgggagagggaagggtgtgagatgggtgagggataaaagactacccattgggtacagtgtacactgctcaggtgatgagtgcaccaaaatctcagaaatcaccactaaagaacttcacctgtttcccaaaactattgaaataaaaataaaaattagaaaagatcagagggaaagaatatgggggaaataagacccccatcaaaaaataagtgatgaaagatactggggaaaaayacaggagagcaggttactggggaaataaagactatttgagaaatgggcaaaaatgataaataatgcaaatccacaatgtaagtttcatattttaaaagtctagacctcttgcagctttgaaacttcatgatgctatttaaatgtcatgtttagtattgtaaataatggtaattttaatcattaatgctaattgctattctctgtggctatattactattcatttattcagtcaatgcatgtttgtttagcactagaaggaacataagcacacatccagtagtctgtattttatttggttt

SEQ ID NO: 7878 - DNA, 601 bp, Human
aatgcctacgtaggtattaaatgtcagctcttatttttaatgctttctagattgcatcagccaaatgggaagaattataaaaaaatgtaaataactacttaaatacattcataaggtcaataataacaaaattttataatacttcttcataaaccttggatttgttttattgcttctaggttctcatagtgattttgatagcctatcttatcatttgttactatatctttgttaggtataaatgttcaggcttcacctattaccaggcatattaaatttcacaagagaaatgtgtagttayagctccaaggcaggtgttatgatcctgtcaaattgctcaggctaattttaaatcatatcaggtctgttgctgggagatgtttgaggaacacaggaaattatatggagcctgttgataacagcctgtccttatcctgtgacctaaaataataccaaacttgccacattaccaaccctcttgtttaaatgtaaaacccatattggaggtttacaccaatgtcattaaaaaaagaaagttaggattcaaaaatatgattgtaatttttgaaatcctggtagcgaaaatttagctgaaattggc

SEQ ID NO: 7879 - DNA, 601 bp, Human
tcataaaccttggatttgttttattgcttctaggttctcatagtgattttgatagcctatcttatcatttgttactatatctttgttaggtataaatgttcaggcttcacctattaccaggcatattaaatttcacaagagaaatgtgtagttatagctccaaggcaggtgttatgatcctgtcaaattgctcaggctaattttaaatcatatcaggtctgttgctgggagatgtttgaggaacacaggaaattatatggagcctgttgataacagcctgtccttatcctgtgacctaaartaataccaaacttgccacattaccaaccctcttgtttaaatgtaaaacccatattggaggtttacaccaatgtcattaaaaaaagaaagttaggattcaaaaatatgattgtaatttttgaaatcctggtagcgaaaatttagctgaaattggcaattatatttgacaaaatatttaatataaatcaatgtgatgtttagttcaattacctcaggaatatatagagttatcactgatggcctaaggccatgcattccaagcttgggtgatcataagcattacctgtggtgtgtttctgca

SEQ ID NO: 7880 - DNA, 601 bp, Human
gtaagataaatttcttaatgctaatgcctccaaatgaagacatttgatttatctctaaagtatatttttaagtatagaaactgtaatgagtggctagattactactctgttttaaaatgtgttacaagacagctttcatcatgtcaatctacggatccaacaattaaaagaaaggttaccgaaattgtacacagatagaagtttacttcatatagccctggcattccagtctcttctaagaatgtgaaataaaggattgatagatggataaacacatggtagatggaggtctgattcaggyggtgttaaaaatcaaacaaaaatctttccaaagtagggatcaaattctacttcttttgagatataaactgtttatagctttgaaatgacagttttcacctcagcacacccattaaatttttatggaacccttcctcgtctattaatacatggcatataggaggggctcaatataatttagttccccttaaatgctttggtatgtgatttggagagagcagctgacatagttgaatatatatcagatatatggttagaaaaatatcgcatagcatctgtagcagaaaaattagttttctga

SEQ ID NO: 7881 - DNA, 601 bp, Human
gacacacattgtgtgtgtaatgtctgtcttggtttttggtggaccacttaaaagtttataaaaatagttttttaaggttctgatgacttttctgcaatataatttgtaagtgcttatatatctccaacctgtaactatgtaaattactgtgaataattttgtccttaatgaaactctgtctgcttctctgtctgtgattaaagattatgaataaaatgcatcggtcttttttgtcctacattctcctctgcaaggtcaggagatagggtttgtcagggcccagttctagcactgtcttaaractccatcctcagaccctccttctccccgttaccatcactgcaaaacttaccctataaagcagatagcttccaaattaacctactttgaacattttttatcattatgagcaacttcatctagcagatataagtagtgaagttttattcagattgttacatttgaagggattttataatttgtcacattacggtagagagccctgtggcctcccaaattgtaacaacttttcctccatcacacattgtcattttcttatgccacacattcttctgatgatttttaagtggatttgtaagat

SEQ ID NO: 7882 - DNA, 601 bp, Human
aatttagacaatcctttctcttggctctcaagtatattgtctcactgtacaatcctcttttgaattcccaaagccgaatattaactctttctttcttcgcattgcttctgtaataatcctaaacttcctcactccctttccttttccaagttcaaatgcagaagcttcaggctgcctaaggataaaatgcgtttatgaagaattcctttacacagaacttttctgggagtaaatctctgttaagcatgtagtagatgttgtacaaagtttattgtgtagataaatccatgggttaatgggwggaaggggaggtagaaattacagactttgtggaatgagtagatttcaaatcatccttggaattttcaagattttactcaaggagctgatatttagagcttagatacacctctactattttataaataaagggccagctgaaccgtatgagtttcttacttagcagaattggagctcttgcttttttgtctttcatcctctatcccaaagatttgttgaaggatgatgaactgaatgaaggctgggtatctttaagaagataccaacaatgtcacttattgaaaaaaaaaaagctatttcg

SEQ ID NO: 7883 - DNA, 601 bp, Human
acctaagcctgtagaacatctatctcattttctttcttttgacacaagtccattagcttcatctgtcttgaggacaatcccggctaagagcctatctgatgtttcttctttggggacctttcagaatttcaaggttataggaaacttggctttgtgcaaagtatgttgccatctgttgctagtttctaatttcagatccatttaagagatttgccaggttagatttatatagacattttaactaattctatttctttgtacttaacccaagatcacatacttaggtttgtcctttcaatawcatttatcagaatactccactattcagccactttgaggagacacattgtttacctgccacttgctgtgataagacattacatgcagcatgtgtttatttggtagttatcaaataataatgcctggtaacagacagccaaaaagcaaacaggggatttagaggttcctgtttatttttgtttgtttgttttgttttaaataagtaaattgaaactcagagcaattatgcggcttacttaaagtctcaaaattagctcatatttcagatgaaatttgccttcaagttctagatcacctgcag

SEQ ID NO: 7884 - DNA, 601 bp, Human
tagacattttaactaattctatttctttgtacttaacccaagatcacatacttaggtttgtcctttcaatatcatttatcagaatactccactattcagccactttgaggagacacattgtttacctgccacttgctgtgataagacattacatgcagcatgtgtttatttggtagttatcaaataataatgcctggtaacagacagccaaaaagcaaacaggggatttagaggttcctgtttatttttgtttgtttgttttgttttaaataagtaaattgaaactcagagcaattatgcrgcttacttaaagtctcaaaattagctcatatttcagatgaaatttgccttcaagttctagatcacctgcagcactgaagttttggtgaccatttattcttcagattgtatttatgattccttgattaacaaatctttaaaaagttgtgaaaattattttctggcaaacattggaaaagggctaaaatatgataatactgtagtcagaaaaaaactattcaaagacacacttgtatacaaataaatatatttttattacatatgcttcatacgcactttctcacatacagagctctaactt

SEQ ID NO: 7885 - DNA, 601 bp, Human
atgaactgatcagcaagagcatggaagttgccaaccctttttaacttttatgtagtttactctatattccaaattaattgtccagaaagagtattgactttaaatgggctccaaaatatataagtagcaggaatggtggctgagacaaaactcctggtgttcattgcttagaaatgtctgatgtggaagtgatggaaatggtgggatctgagctggccgttgtcgtagctgtgaacgaattcacatttgtttcccaggccccacacaggtaatgctctgtctgtattccacagacagacasacggtcaaccccacaagggtgcttttctgttcccttcctagagtcctctcatgaaaatgtgcttgttctcatctcatcccctcaaggtttggctttctacttcactgactccccggatttaatccatgtatgggtgcagctcctcaacagtgggattgctatttgtgtaggaatcttctgggtccccacactttttttttttgtacaaagaggtaactagcaaaagggattttttttaagtaaatgatttttggtacacttccaatcagtctatatgaagggcctacctcctataaggat

SEQ ID NO: 7886 - DNA, 601 bp, Human
ttatgtagtttactctatattccaaattaattgtccagaaagagtattgactttaaatgggctccaaaatatataagtagcaggaatggtggctgagacaaaactcctggtgttcattgcttagaaatgtctgatgtggaagtgatggaaatggtgggatctgagctggccgttgtcgtagctgtgaacgaattcacatttgtttcccaggccccacacaggtaatgctctgtctgtattccacagacagacacacggtcaaccccacaagggtgcttttctgttcccttcctagagtccwctcatgaaaatgtgcttgttctcatctcatcccctcaaggtttggctttctacttcactgactccccggatttaatccatgtatgggtgcagctcctcaacagtgggattgctatttgtgtaggaatcttctgggtccccacactttttttttttgtacaaagaggtaactagcaaaagggattttttttaagtaaatgatttttggtacacttccaatcagtctatatgaagggcctacctcctataaggatgggcatgagtaggggaattagaagaagattaagggggggtctttagt

SEQ ID NO: 7887 - DNA, 601 bp, Human
ttccaaattaattgtccagaaagagtattgactttaaatgggctccaaaatatataagtagcaggaatggtggctgagacaaaactcctggtgttcattgcttagaaatgtctgatgtggaagtgatggaaatggtgggatctgagctggccgttgtcgtagctgtgaacgaattcacatttgtttcccaggccccacacaggtaatgctctgtctgtattccacagacagacacacggtcaaccccacaagggtgcttttctgttcccttcctagagtcctctcatgaaaatgtgcttgktctcatctcatcccctcaaggtttggctttctacttcactgactccccggatttaatccatgtatgggtgcagctcctcaacagtgggattgctatttgtgtaggaatcttctgggtccccacactttttttttttgtacaaagaggtaactagcaaaagggattttttttaagtaaatgatttttggtacacttccaatcagtctatatgaagggcctacctcctataaggatgggcatgagtaggggaattagaagaagattaagggggggtctttagttggagctaccagggaggtg

SEQ ID NO: 7888 - DNA, 601 bp, Human
tcagtctatatgaagggcctacctcctataaggatgggcatgagtaggggaattagaagaagattaagggggggtctttagttggagctaccagggaggtgtatgagatttcatggtgtctgtctgggacctggtaaggagtaacctttcccatttgtgtaggtgtatttacagttgacataactggtatagctttcctttatctcaagacaggacaaataatactgtaattctaggtaaaagcaattcattgagagagaaactgatatatcttacattgtatatttcataatatagtgaracattttgaaagcttacttgtcttatattggttttcttaatattctttaattttcccaccagcttcaaattccacaatttatctacatgcagatacccaccatttctcacagatacatatattccagcctatatttctccagagttgctatttcttacagaatatttctacttgaatgatttactaatatgtaacctatttttgttgcaaaacaacagatagtgctcagtgtagaatttcacactccaatccaatgtaatctagaggtagacgctcccgggcaggctagtgttcagcagg

SEQ ID NO: 7889 - DNA, 601 bp, Human
gcttcaaattccacaatttatctacatgcagatacccaccatttctcacagatacatatattccagcctatatttctccagagttgctatttcttacagaatatttctacttgaatgatttactaatatgtaacctatttttgttgcaaaacaacagatagtgctcagtgtagaatttcacactccaatccaatgtaatctagaggtagacgctcccgggcaggctagtgttcagcagggacacagccctgggcatatagttgggagacttgggctggggttttctctgccagagcacagrtctctgatcctgtaagtcatttaaattcttgtgtttcaaattccctcactgtaaaaggagtggcttgacctagatgatctcaaaagtctctccaagcttgaaaattctggttctatgattttaatatttaacaatacacataattgtgcttgtgcttgcatgataattaggcatgcatgataatggggcacagtgaatgactgtaattagctttactcctacagagaaaaaatctatttttaagtctttccacttctcatcttattggttttttaaaatattgataatcagtatcaatgg

SEQ ID NO: 7890 - DNA, 601 bp, Human
caaagtagtgaaaaagtgaagctggaaacgaaagacaagttttgattccacttggtgtgttttaatttaagttggccaccaggagttcctgagcaaaggtgctcactgtctctagtggtacttgtcttcctgagatggaagctctcggtccttactccccaagtgaccatgtcacgctccttaagggcagtctctccagatgatgaccaaatggtttgtagggaagattttaactctgatgtggaggggctcttcaagcaaatattttgtctcttctcagtacagtaattaagctgataattttttttttttttaccttttcgggccactacaacattctctgctcttggattcaaagatgaatgttccttccacacagtttaatacgtctacagttccagccgaggttgggggagattttgtctgatcaggatgtttttccaatagtagtgtctggttctgtgttgggatttcactcagtaaggttttccattcagttttatgatttggtactcctggtatgcacatcttaatatatctgacccttcactttaaatttttgttgcactttttcttttttttaaattttgtaccaaaaaaa

SEQ ID NO: 7891 - DNA, 601 bp, Human
cagagattattattctttcaaattacatgaatttaaaaatcatttactaatgaatcctcctgaatttctcagaaaaagaaagaactcgagcagatttacccattggtaaaggaaactgccccttctctgatattgggttggttagtaaccattcagttgcatttttcctgcactttcatgtaagtcagtcatagatgcagaagggcatcctggtgggaagtagcattttacagcctttaagcagactgtttttctaaatataataacaatgaaaactatttggatacacatgtaagtcctytgtgaggcttgagtctagatgaaatatcagagtctactgcaacatccagtctgagggtgcctttgaaccatttcaggacaaaagcaaattaaacttggaatcctatcccaacttcattacctagctgaatgtactcacagttcatctaacctaattgctcttcctgcttcctcctgacagtaaatgaaataataatgacaattattttaaaacagtaaagggatatataacttagtggttgttattctgattactactgtgtgtctcctctgcttcacaatgggtagagtttagtttgat

SEQ ID NO: 7892 - DNA, 601 bp, Human
tttaaggggttcaggaggtgtgtactccacagaaggcattgctgaacctgtggaagaaatgctaacaagaatttgaagaatcagactccaggaatgggaaacactattctgaaataatggaggaaaagagaccacattcctttcttgggggctgggatcaagaaagggcccccaggtgggccaggaactcacctgggctggatccatgcagagtttgttcatggttattagagattatgcctttagaagtgacactagtgggcacccctgaaatgacctccaacacaccccctaggggagyacaccctgagtttcccgaaaaatgaggaaccactgacaacagaaagaactggttttctttgtgtggaggggttagtccctgggagggaataatcttccttcagtctcaatagctaaaactgtggggaagtgatgaatggtagacttgagactttcctttgctgttaaggatgatggactagatgatggatgctgttaaagatgatgatgttttgggacatcagagcaaccaataactaaacagcagcctgtgataggctggagcaggttgtcactaggaagacagggagtattcaagtct

SEQ ID NO: 7893 - DNA, 601 bp, Human
ctccacagaaggcattgctgaacctgtggaagaaatgctaacaagaatttgaagaatcagactccaggaatgggaaacactattctgaaataatggaggaaaagagaccacattcctttcttgggggctgggatcaagaaagggcccccaggtgggccaggaactcacctgggctggatccatgcagagtttgttcatggttattagagattatgcctttagaagtgacactagtgggcacccctgaaatgacctccaacacaccccctaggggagtacaccctgagtttcccgaaaaatraggaaccactgacaacagaaagaactggttttctttgtgtggaggggttagtccctgggagggaataatcttccttcagtctcaatagctaaaactgtggggaagtgatgaatggtagacttgagactttcctttgctgttaaggatgatggactagatgatggatgctgttaaagatgatgatgttttgggacatcagagcaaccaataactaaacagcagcctgtgataggctggagcaggttgtcactaggaagacagggagtattcaagtctggctttctctaaatcgtgaaatca

SEQ ID NO: 7894 - DNA, 601 bp, Human
gaaataatggaggaaaagagaccacattcctttcttgggggctgggatcaagaaagggcccccaggtgggccaggaactcacctgggctggatccatgcagagtttgttcatggttattagagattatgcctttagaagtgacactagtgggcacccctgaaatgacctccaacacaccccctaggggagtacaccctgagtttcccgaaaaatgaggaaccactgacaacagaaagaactggttttctttgtgtggaggggttagtccctgggagggaataatcttccttcagtctcaayagctaaaactgtggggaagtgatgaatggtagacttgagactttcctttgctgttaaggatgatggactagatgatggatgctgttaaagatgatgatgttttgggacatcagagcaaccaataactaaacagcagcctgtgataggctggagcaggttgtcactaggaagacagggagtattcaagtctggctttctctaaatcgtgaaatcattattctcactttgatggttttaggctaatttgacttggtaaagcaaagattacataaaaagttcagattgtggctgaaacacagg

SEQ ID NO: 7895 - DNA, 601 bp, Human
gcaaccaataactaaacagcagcctgtgataggctggagcaggttgtcactaggaagacagggagtattcaagtctggctttctctaaatcgtgaaatcattattctcactttgatggttttaggctaatttgacttggtaaagcaaagattacataaaaagttcagattgtggctgaaacacaggcatgtccttcaatctgtaaaagataaaggcaattaaaaaatgaactgtaaatgaagacatatttttgctaaatgttggaataattgttaaaaataattattttgctttataaacrtatatttccaggagggctgtcaaaggcactgtggttaggatacatacacttattttttaaaaagttaaagatctgtttttcttataaaactgttcatcccttttgtgcttgacacatgctaccagagatacaaagtagatggaaaggaatcatgccctctcagagtcacgatccagcaaagaacctgaaaatgacaatctgacacccaagtccaagctcttaactactattttacactgattctcagaattgcttggaagattaaataagatgataataagagtgcatcataaccttatg

SEQ ID NO: 7896 - DNA, 601 bp, Human
ttatgtctcttggctgtctccactactagaatgtaagctccataaaagcaagaactttgtctttcaatactgtatcctcagtacctaacattttgccagggctttatgtattttatacacatttgtaatacgatcaattcaccaaaagttgtacatttagtttctttccagtttactataaacactgcatgatgagcatctttacataaaaatatttgtctacgtttctgatcatttccataagatagactggtaggagttattgaattggtaggtatggaacatcttatctcttatattygccaaactgctttataagaatatggttctatttactttcctgccagcaaagtgtgagcttccattttatcacatcatcactggaattgaatattttcatatttaaatatttgctaatttttctcactaaagcttagagggtgtgttttctgataaatattaagttttattatattatggatatttatgcttggtcatatttttgaaataaaatttacattgttttattctatgttagaagtcttacatttatatgtagtcaaatcaattgattttttatttgtgatttctgtcattatta

SEQ ID NO: 7897 - DNA, 601 bp, Human
ttatatttgccaaactgctttataagaatatggttctatttactttcctgccagcaaagtgtgagcttccattttatcacatcatcactggaattgaatattttcatatttaaatatttgctaatttttctcactaaagcttagagggtgtgttttctgataaatattaagttttattatattatggatatttatgcttggtcatatttttgaaataaaatttacattgttttattctatgttagaagtcttacatttatatgtagtcaaatcaattgattttttatttgtgatttctgtmattattaagaaagtttttgtccagagctcagatgaatattccatatttggttctttgatgttttcaatatttcaactctttgagaaactttttaaatcaaatttattgtaataaactgtattttaaggttttttaaaaaattctctcctttcccaaacttgaaactggctcccgttagtaaagaacattggctcatattaatagaaaacattgactaaggaaccaaacataaatcacaaacaaaaaagaaaagaaaagtaaagctttcatatctgtcatattagtccattttcatgctgc

SEQ ID NO: 7898 - DNA, 601 bp, Human
gttttctgataaatattaagttttattatattatggatatttatgcttggtcatatttttgaaataaaatttacattgttttattctatgttagaagtcttacatttatatgtagtcaaatcaattgattttttatttgtgatttctgtcattattaagaaagtttttgtccagagctcagatgaatattccatatttggttctttgatgttttcaatatttcaactctttgagaaactttttaaatcaaatttattgtaataaactgtattttaaggttttttaaaaaattctctccttycccaaacttgaaactggctcccgttagtaaagaacattggctcatattaatagaaaacattgactaaggaaccaaacataaatcacaaacaaaaaagaaaagaaaagtaaagctttcatatctgtcatattagtccattttcatgctgctgataaagacatacccaagaccgggcaatttacaaaagaaagaggtttaatggacttatagttccgcatggctggggaggcctcacaatcatggtggaaggcaaggaggagcaagtcacatcttacgtggatggtggcaggcaaagagagt

SEQ ID NO: 7899 - DNA, 601 bp, Human
tgttttcaatatttcaactctttgagaaactttttaaatcaaatttattgtaataaactgtattttaaggttttttaaaaaattctctcctttcccaaacttgaaactggctcccgttagtaaagaacattggctcatattaatagaaaacattgactaaggaaccaaacataaatcacaaacaaaaaagaaaagaaaagtaaagctttcatatctgtcatattagtccattttcatgctgctgataaagacatacccaagaccgggcaatttacaaaagaaagaggtttaatggacttayagttccgcatggctggggaggcctcacaatcatggtggaaggcaaggaggagcaagtcacatcttacgtggatggtggcaggcaaagagagttgttcatggaaactcccattttttaaaccatcagatctcatgagactcattcacgatcatcagaatagcacaggaaagacctgcccccataattcaatcacctctcactaggttcctgccatgacacctgggaattgtgggaattacaattcaagatgagatttgggtggggacacagccaaaccatatagtcttttatatctgttta

SEQ ID NO: 7900 - DNA, 601 bp, Human
aatatttcaactctttgagaaactttttaaatcaaatttattgtaataaactgtattttaaggttttttaaaaaattctctcctttcccaaacttgaaactggctcccgttagtaaagaacattggctcatattaatagaaaacattgactaaggaaccaaacataaatcacaaacaaaaaagaaaagaaaagtaaagctttcatatctgtcatattagtccattttcatgctgctgataaagacatacccaagaccgggcaatttacaaaagaaagaggtttaatggacttatagttcckcatggctggggaggcctcacaatcatggtggaaggcaaggaggagcaagtcacatcttacgtggatggtggcaggcaaagagagttgttcatggaaactcccattttttaaaccatcagatctcatgagactcattcacgatcatcagaatagcacaggaaagacctgcccccataattcaatcacctctcactaggttcctgccatgacacctgggaattgtgggaattacaattcaagatgagatttgggtggggacacagccaaaccatatagtcttttatatctgtttattcttat

SEQ ID NO: 7901 - DNA, 601 bp, Human
aaaccagaagtctccttgatggcatcagctaagggaggaagaattccttctctcagacataccaaaatgtgcaatttccttttcagtctgcagattaatttgaatgttgtcattctaatttgaaataatacccctctgacaaatagtagcagttactcctgtggattttgtgtttctttgtaattcgactactcgtcctattttttctatcctcatttaagtcattttacttccaagctcagatggatatccctcttccacttgcctttgtgtttgatgatctgatctcttcttctgcatrttatttctactttgcctttgctgggttatttctgtatttcttcctcacttctcgcttatttctatttttattcccattctgggtccactcgtgcttctcctcaggccactcaccatccaggaaatttctgtctccacgtctcttctaagatttacctgtacttaagaatttccattttctgaatgatgtttcaaatttagaaatgtggatttaggtctatttgctttgtaagatttatgtttcacaaatttatttattttccttgagaattagtgaacaaatggttaggtaaccttgagt

SEQ ID NO: 7902 - DNA, 601 bp, Human
catggggtggttgaccttttgttttgagagccagagtgctgcaaggaaatgtagttattctttgactggaagatgtcttttctgttctgaatgttctgaggtatgtggattcttatctataattaccttcccttaagtcaatctgcatgctaaagcctcccccaggtcctgcatctgtgcctcattctttgaagctgggattcagaatatattataacagaataaattataaagattgcttgggtgtttcctgtaccaggacatagcagtggtttggtgtcctgcccatttgtgtggcagraaattcttttgtttgtgctggtgaatcgttttgtctggggcttctttctttgctaaaaatcttgcattctttcatttggcaagcattttgtcaacaactttaacttgcaagaactatgggtccacctatttaggcattatcgatgagaacttctaaaggaacagcctttgagtgtacagtactatggcacacacccctaaggaaccctctatgagtaatgggtttgtataattcctttttcttcagtggaacctaggacttgcctgatattccagagagtgtgaagagggatatttaaaa

SEQ ID NO: 7903 - DNA, 601 bp, Human
gagccagagtgctgcaaggaaatgtagttattctttgactggaagatgtcttttctgttctgaatgttctgaggtatgtggattcttatctataattaccttcccttaagtcaatctgcatgctaaagcctcccccaggtcctgcatctgtgcctcattctttgaagctgggattcagaatatattataacagaataaattataaagattgcttgggtgtttcctgtaccaggacatagcagtggtttggtgtcctgcccatttgtgtggcaggaaattcttttgtttgtgctggtgaatygttttgtctggggcttctttctttgctaaaaatcttgcattctttcatttggcaagcattttgtcaacaactttaacttgcaagaactatgggtccacctatttaggcattatcgatgagaacttctaaaggaacagcctttgagtgtacagtactatggcacacacccctaaggaaccctctatgagtaatgggtttgtataattcctttttcttcagtggaacctaggacttgcctgatattccagagagtgtgaagagggatatttaaaaataaaaatgaaaaagtgttgcccccat

SEQ ID NO: 7904 - DNA, 601 bp, Human
ttctaagtctaaagcctttaaaatggtcagtaattattatacttcaaattaatgaagaaccattgaccccatgaaatcaagttctgaaattgaccaacaagtaatgaattgttaacgaggatgtattattcacatctgcagtaattattttgcaccaatattctagatttaagtgatcttggaaaatatcatacatgtgatactcctgatctcaaagaacaacttagtaatgtataattatttttatttttctgcaataactgagaatgaagtgcatatttaaataaatatttatatagtrtttgtttattcaatgtgaatttcatcatataaagttaatgccctaaatttaatatcttttgcattattgtggcaattgtgatagttaacacatctgtaaacacaaacacatgttctgtgtttccatttgatgacctataaatgaagacacattctaaagtgagacaaaataactatatcctaaatattctatcctaaacgtccccatattcttgcattgtatgaagaagtgtgttggctggtgtatgctaatttaatagttagatataatttggttgcttgatggaagataaagggaaac

SEQ ID NO: 7905 - DNA, 601 bp, Human
aagtctaaagcctttaaaatggtcagtaattattatacttcaaattaatgaagaaccattgaccccatgaaatcaagttctgaaattgaccaacaagtaatgaattgttaacgaggatgtattattcacatctgcagtaattattttgcaccaatattctagatttaagtgatcttggaaaatatcatacatgtgatactcctgatctcaaagaacaacttagtaatgtataattatttttatttttctgcaataactgagaatgaagtgcatatttaaataaatatttatatagtatttrtttattcaatgtgaatttcatcatataaagttaatgccctaaatttaatatcttttgcattattgtggcaattgtgatagttaacacatctgtaaacacaaacacatgttctgtgtttccatttgatgacctataaatgaagacacattctaaagtgagacaaaataactatatcctaaatattctatcctaaacgtccccatattcttgcattgtatgaagaagtgtgttggctggtgtatgctaatttaatagttagatataatttggttgcttgatggaagataaagggaaacttgc

SEQ ID NO: 7906 - DNA, 601 bp, Human
atttttctgcaataactgagaatgaagtgcatatttaaataaatatttatatagtatttgtttattcaatgtgaatttcatcatataaagttaatgccctaaatttaatatcttttgcattattgtggcaattgtgatagttaacacatctgtaaacacaaacacatgttctgtgtttccatttgatgacctataaatgaagacacattctaaagtgagacaaaataactatatcctaaatattctatcctaaacgtccccatattcttgcattgtatgaagaagtgtgttggctggtgtrtgctaatttaatagttagatataatttggttgcttgatggaagataaagggaaacttgcagtttgaaagcagtcagaatgttaacatctgttaaaaatttgctaagtttcatcactgaaattgccatgacttagtactttagagggaataattatctcccttggaaaaaactaatcactttagaagtgcataaacacttctaagtcacaaaggtgctgtttcatgaatgacatcaaattattattattttttttggttaggaatcagttttaggagctaatttatttcctaaagtctctc

SEQ ID NO: 7907 - DNA, 601 bp, Human
aatgaaccaatttgggatactcaacactttcattaaaataaagttatgaaattatgtttggttttgtctttgttttgggaggttatgataagacttataatacttaattggtgattccacattttaaatattaatgttagtaaatctggatgtaaatccattatttacatatgaatgatgtaaaatacaactgattctagtcataggagtacaattttttatcacaagctagctatataaataatcctctattaaaaccccgggtatttttttttttagcccagcattttgatggtacacaaaactttagacaacaagatggtagggtttctttaagtgtgtgttggtagtaagaaatagttccattggagaaaaacaaagaattgcttcgttggtgagtctttccactagttcttgttgggttgtgttagccgagaaccatttgcagttactgagacatgctgggatacctctcagggttttagaagcagcaaaggtatctgccatttttttttctttttctttcattgatggtaatttgtttggttttgtactgaccaggtgctgaccaaagtatttatgtatgcagacatatttctgc

SEQ ID NO: 7908 - DNA, 601 bp, Human
gggagaaaaagaacagtatattgattagcaccattactgaggatatcatttcagtttgtcttagacagggatcccccaggtatgtataatattggccttgagaaaatgtaattctgccatacaaagtctaattcaaatataatggcatttatgtttttatcaatgtaacaataatttacattaattacattcttactatgtgttggagaccatattagtacattgtaaaccctgtcttgcttaatccaataatctcatggggatatttactattttatctccatttacagttgaggaaacwgctcaaatcacttttccaattactcagctagttaccacagttaggacttgcactatgtttttagctattatacttagacatacaagttgaaggcagttcttgatgttttaaagtaattgttgtaaagacagatacatgcacacccacatgcagaaaatactcctttttctaatagatactaaactttaaaaataaagtcagtggtacgcattaaaaatacgtatgttcaaatccgtaatggaatatcaaggggagcctggaaatattttgaaaataaacctttttgggggtgatgtgaga

SEQ ID NO: 7909 - DNA, 601 bp, Human
tcctgctataaatgatgatccattggtgatgataatgattatgatgatggtgatactgacactaatgctgtattcatttagcaaatgggatagaaggaggtccccatttctacatcagtgtctcatgtggtaaaaagattcagatatttactcattgatgtagtaatatatttcctgtcaataaagccatgtgtgtatatagtgatttattagtatggggtaactgctcatgtttgagcatgtcgacatgctttttgagtttagggttgaaatattagccttgtgttactagtaataaaaygaaaatccagtgagagggatttgctgcagatcacatagaatttgtactcaagttcctgtcttcttttccatctacttctctttctgtgttatcatagttcccataaaaaaataatatgaaagactctaagattcaatgaaaaacataaattttgtgggatttcttcataactttttgacacaaaataaataagatgttagaatcagtggttgagtacgatcaaaactccagatgaaattattttttgcatctctttttttaaccaattattagcagtgctttttagagagcagcatttat

SEQ ID NO: 7910 - DNA, 601 bp, Human
gtttgagcatgtcgacatgctttttgagtttagggttgaaatattagccttgtgttactagtaataaaacgaaaatccagtgagagggatttgctgcagatcacatagaatttgtactcaagttcctgtcttcttttccatctacttctctttctgtgttatcatagttcccataaaaaaataatatgaaagactctaagattcaatgaaaaacataaattttgtgggatttcttcataactttttgacacaaaataaataagatgttagaatcagtggttgagtacgatcaaaactccakatgaaattattttttgcatctctttttttaaccaattattagcagtgctttttagagagcagcatttattttgtttaaccttgcaatgagagagtttcaggcccagttttttaaatgagtgtgatagtagccaatgatagagaaaaatccagtattcctagggaataaaaattgaagaagtaatcatctggccttggaagtatgtatcagcatggccaagtcatgtatcagcttccatctttcactgttgccatagttccatggaggtgatggaatccaatcatgttcttttaaaggata

SEQ ID NO: 7911 - DNA, 601 bp, Human
caagcatttttctagaagcaagggacatagcaacagatacaactgacgaaaatctctgcttacatgcatctttcattgtaatatgggaaacagacaataagtgagaaaataagtaaaaaataaagtaggttagatggtgataaatactacagaaaaattacatgggagggaggatcagggatttttgggccgatgagaagcaattttaaattgggttgccagggaaggcctgcaaatccaaaggacctcacttttgtatccagggaacaagacagagaccagtgtgcctggatctggaccsaagggaatgagaagggagggtgggaggagatgacgtcagaggagtgatgggtggggacagaagatgccatggagtctcattgaaccagctcgaagacctggacagaagaggattgcttctccatcctggcagcatggagaaggccttgttccctgtgtgattcccacaggagtgccgaagagcatcctgcccctttcctgatgtatccatttacaatccgcacaagtaaaattgcaacagctgtccctctggactagttcttttcctttctttctttttccttacctttccttttcttgc

SEQ ID NO: 7912 - DNA, 601 bp, Human
tatgggaaacagacaataagtgagaaaataagtaaaaaataaagtaggttagatggtgataaatactacagaaaaattacatgggagggaggatcagggatttttgggccgatgagaagcaattttaaattgggttgccagggaaggcctgcaaatccaaaggacctcacttttgtatccagggaacaagacagagaccagtgtgcctggatctggaccgaagggaatgagaagggagggtgggaggagatgacgtcagaggagtgatgggtggggacagaagatgccatggagtctcatygaaccagctcgaagacctggacagaagaggattgcttctccatcctggcagcatggagaaggccttgttccctgtgtgattcccacaggagtgccgaagagcatcctgcccctttcctgatgtatccatttacaatccgcacaagtaaaattgcaacagctgtccctctggactagttcttttcctttctttctttttccttacctttccttttcttgcttttttttttctttttgtcttcagcaacagaaattcattttctcatagtcctggaggctcaggttcaagatcaagatgctg

SEQ ID NO: 7913 - DNA, 601 bp, Human
ctaactgaatgtcaaattaatgaggttttgctatctacatggcatgttttgacaaaaatactgtgtacctttattgacagtgaaccttctgctctggagtaatgctaatccaagactgctggtttttcatgttaaaacccataaacttgttattagagcagatgacttccaaaacgtcaaaactaaagatgttgcttattcactagaggagtttatgttgttcacatttaagatgatttatttttattcacttgacaacacttcgaacttcaaatggatgcacacaagccaattcttggagggttgtgactgcagaaaaaaaattaaatcttgtgctcatgtgttgctccatcatagtaatcctcagttttgtcccagaagtagcatgtgtcacttccagtgattcaggaccagctggtagaaaggacggacatttcatgctgccatgagcaactgctgtgtggtccaggatgacttttccaaaagcttcactcactgctcctcagaccacgtctgtttttgtagaggcaaaatgagatggctgagagaattgtggactctggccaaatgagtagtcattccctggctgtaagtgggtgaa

SEQ ID NO: 7914 - DNA, 601 bp, Human
gcagatgacttccaaaacgtcaaaactaaagatgttgcttattcactagaggagtttatgttgttcacatttaagatgatttatttttattcacttgacaacacttcgaacttcaaatggatgcacacaagccaattcttggagggttgtgactgcagaaaaaaaattaaatcttgtgctcatgtgttgctccatcatagtaatcctcagttttgtcccagaagtagcatgtgtcacttccagtgattcaggaccagctggtagaaaggacggacatttcatgctgccatgagcaactgcygtgtggtccaggatgacttttccaaaagcttcactcactgctcctcagaccacgtctgtttttgtagaggcaaaatgagatggctgagagaattgtggactctggccaaatgagtagtcattccctggctgtaagtgggtgaaagagaggtgacagaaccatttttactgcagtgcagtgtgattaatctgtgtcttcttaatgagattaaggggaaaaacaaactttttttttaatttttttttttttttaactagctctcctctatactgcaagttaaacaacttattctggcagaag

SEQ ID NO: 7915 - DNA, 601 bp, Human
ttccagtgattcaggaccagctggtagaaaggacggacatttcatgctgccatgagcaactgctgtgtggtccaggatgacttttccaaaagcttcactcactgctcctcagaccacgtctgtttttgtagaggcaaaatgagatggctgagagaattgtggactctggccaaatgagtagtcattccctggctgtaagtgggtgaaagagaggtgacagaaccatttttactgcagtgcagtgtgattaatctgtgtcttcttaatgagattaaggggaaaaacaaactttttttttaatttttttttttttttaactagctctcctctatactgcaagttaaacaacttattctggcagaaggttgaaagaagggaacaattgctcctttgctagaaattctcttcattaggagcatagcctttcaaaaaacaatgccactcatgatatgcttcagattctatataatcatctcatgttgcacttctcctaatttattttataaaagaagttcttttttggtgagagatagattgtaaaactcaatgtattcttattcttttttttttttgcaattattcctgaatacaaaacttaaaa

SEQ ID NO: 7916 - DNA, 601 bp, Human
tggctgtaagtgggtgaaagagaggtgacagaaccatttttactgcagtgcagtgtgattaatctgtgtcttcttaatgagattaaggggaaaaacaaactttttttttaatttttttttttttttaactagctctcctctatactgcaagttaaacaacttattctggcagaaggttgaaagaagggaacaattgctcctttgctagaaattctcttcattaggagcatagcctttcaaaaaacaatgccactcatgatatgcttcagattctatataatcatctcatgttgcacttctyctaatttattttataaaagaagttcttttttggtgagagatagattgtaaaactcaatgtattcttattcttttttttttttgcaattattcctgaatacaaaacttaaaaaatgacaccagggctttatgtctagagtagactgtgaaaaaaatgaatacacatttatttgggaaagatattggtggtcattatgccaattgacatatagttgtcatcactgatgtaattttgcatttgtttgtgtaattatttaattaacatctgtttctcctactgtagtatcaggttcttttttag

SEQ ID NO: 7917 - DNA, 601 bp, Human
tgctcaatgtgttttcagaagttttggatattacaaagttttttcttttattgaactgatatatgttcatatatagactttaccatttaaaaataaaataattgtatggaaaaatgactgatattaagggacaaccttctttatgtaatttatgtcctgattaatggacttttcttgtttgggattcattccttttcattcaagcattgttcacaaaactggattagttgttaattacaaatggcctaaactattttaagaaagaattttattatggaaaaataagagtactataaaaaargtcagttggggtcaccttgtctattgcaactaaaatagaattgactcagagctacattttcgtcacctccttttcctacctctttcttggcccccttattctggccttagattactctgcagaaacacaggcaccttgttttttttttttaatgtggaaaaaattaggtttctttttcttattcttccactattccagatgaattccgtgtctattttctaataaatgttaactattttgaagagaaatgcattactcccatagaaagaacaaatacttgcaatcagtgatgttttacac

SEQ ID NO: 7918 - DNA, 601 bp, Human
taattgtatggaaaaatgactgatattaagggacaaccttctttatgtaatttatgtcctgattaatggacttttcttgtttgggattcattccttttcattcaagcattgttcacaaaactggattagttgttaattacaaatggcctaaactattttaagaaagaattttattatggaaaaataagagtactataaaaaaagtcagttggggtcaccttgtctattgcaactaaaatagaattgactcagagctacattttcgtcacctccttttcctacctctttcttggcccccttrttctggccttagattactctgcagaaacacaggcaccttgttttttttttttaatgtggaaaaaattaggtttctttttcttattcttccactattccagatgaattccgtgtctattttctaataaatgttaactattttgaagagaaatgcattactcccatagaaagaacaaatacttgcaatcagtgatgttttacacttactatttctattttaatttgtatttattataaaaataggggatatgtgcacacttgaaaacattctcgttgtgtaacattagagtattacagttaa

SEQ ID NO: 7919 - DNA, 601 bp, Human
atgtcctgattaatggacttttcttgtttgggattcattccttttcattcaagcattgttcacaaaactggattagttgttaattacaaatggcctaaactattttaagaaagaattttattatggaaaaataagagtactataaaaaaagtcagttggggtcaccttgtctattgcaactaaaatagaattgactcagagctacattttcgtcacctccttttcctacctctttcttggcccccttattctggccttagattactctgcagaaacacaggcaccttgttttttttttttwatgtggaaaaaattaggtttctttttcttattcttccactattccagatgaattccgtgtctattttctaataaatgttaactattttgaagagaaatgcattactcccatagaaagaacaaatacttgcaatcagtgatgttttacacttactatttctattttaatttgtatttattataaaaataggggatatgtgcacacttgaaaacattctcgttgtgtaacattagagtattacagttaaaactgaagccctctttaagcagtaatacctctattattaagcatttaaatata

SEQ ID NO: 7920 - DNA, 601 bp, Human
ttggggtcaccttgtctattgcaactaaaatagaattgactcagagctacattttcgtcacctccttttcctacctctttcttggcccccttattctggccttagattactctgcagaaacacaggcaccttgttttttttttttaatgtggaaaaaattaggtttctttttcttattcttccactattccagatgaattccgtgtctattttctaataaatgttaactattttgaagagaaatgcattactcccatagaaagaacaaatacttgcaatcagtgatgttttacacttactrtttctattttaatttgtatttattataaaaataggggatatgtgcacacttgaaaacattctcgttgtgtaacattagagtattacagttaaaactgaagccctctttaagcagtaatacctctattattaagcatttaaatatatatgcatatatacatatatcattgtttttatgggttttgatatgtggtacctcaagactctcttctctctatttttccaaatcaatatcagtgaatcataaattttgcattttcatatatgttcatatatatttctgatatatgttgtttgtttt

SEQ ID NO: 7921 - DNA, 601 bp, Human
gtattctcattgttcaactcccacttatgtttattgcagcactattcacaatagcaaagacttggagtcaacccaaatgcccatcaatgatagactggataaagaaaatgtggcacagatacaccatagaatagtatgcagccataaaaaaggatgagttcatgtccttttcagggacatggatgaagctggaaaccattattctcagcaaactaacacaggaatagaaagccaaaggctagtttctaggcgctcttttggtttgattttgaaatctgaaaaatcagcattgaagttataggtgtgtgtgtgtgtgtgtgtgtgtgtatgtaagaaaagttcagtaaacacctttagcacccaaattaaacactagttagcatttttctataatatatttttatgtttattcatctataatgccatcatagatttatgtattatctgcttataattttttctgaattatttgataagttgcaggtatcatggcattctacccccaaatactccagcttgcatttactaaaaataagaacattttcttgtatcaacataatgccataatcacacccaagaaaaataataatttcttatataa

SEQ ID NO: 7922 - DNA, 601 bp, Human
ttttttctgaattatttgataagttgcaggtatcatggcattctacccccaaatactccagcttgcatttactaaaaataagaacattttcttgtatcaacataatgccataatcacacccaagaaaaataataatttcttatataatatctaatttaaagtaacattttcctattatttccagaatatttttaaagctagataccttctttgattctatgccaacaaaaattcagacaccctagttatgtctctttagtctcttttttaaaaaatcacatctattaagataaaatttgamttcaatgaatcgcacccatttaaagtatacactttagtgcatattgcccatacatgcatgtttgattctaacttcatgatcaagatacaaaacaatatcatcatctccaaaatatttcctcatgtcccttgactattcatctctccttccatcagcccataggcaaccactgagctactttctgttgttaaaagttagtttgcatttcctataatgtaatataaaaggaatgttgtacattgtactcttctgtgtccaacatcttttgctctgcatgcttttgagattcatccatgctgt

SEQ ID NO: 7923 - DNA, 601 bp, Human
gcccacaattttctatctaaaaaaatcaccttccagtataaaaggcgtagacaaactgttatctataaggaagaactcagggaatattgagtaatctaataaagaaacagcctaaaacaaccaaaatgcctagagagaagagacaggtggtacacattaaacactggtgggaagcattaaaaacatagttacttttgttgacaagtcttactttagtacgaagactagaacaagtcttagtgtagaactatgactaaatgcaggttaatgggggaaaagtatgaaatgtaattatatatakagagagagagagcgcgaggggagagagagagtagtgatggacaatcaaattacattttcactttaaagaaaataatatactatagtgatgtctactagtatcttataagtaagagtaattataataatattagcaattgccttgctgcttctgtgccaggcataattgggtgccatgtatcagggtgatccttttccccacccagggttttgcttagatggttctcccttaaaaatgcttttgccactgtcttctagtttcccagcccttcccttttggtggaaggcttccaaaaccaag

SEQ ID NO: 7924 - DNA, 601 bp, Human
caagacatacaacatgcacatcttaaaataagttgtgtatctgtatttaaagaacgaatttttttcaagttatttcttagaagttatttatttgaagagattatttttaatcatatggttgctgttgaataaatttttaaaacaaaatatgtaaagaagtacacaaaatcattttcagtaattctctccttatccaagaaggcaagttctatcttaagaacctgcacagagtaaatattcagtacattatctatcaagtagtgtgttattcactgcaaattgaaaatcatcaaattcctarttgttctgcttaatagatgcttaactatattttagcagattccaaatatatgttaatatatatttttggaattcagcatgagtatctttagatgctaattgcaagttaatctttcttcctagaatgtaagttccatggattataaacgttattcctattgcagattttctaaatagtgtttctgctggtgaagtcttcttcactctctggtgcttaagattagaaagaaaaaaggaaagtaactgaacaaaagaaattctttgaacatgaaattatcaaatgaaactgtacatatgcaaa

SEQ ID NO: 7925 - DNA, 601 bp, Human
gctaattgcaagttaatctttcttcctagaatgtaagttccatggattataaacgttattcctattgcagattttctaaatagtgtttctgctggtgaagtcttcttcactctctggtgcttaagattagaaagaaaaaaggaaagtaactgaacaaaagaaattctttgaacatgaaattatcaaatgaaactgtacatatgcaaaggaattttaaaccattgccttgcaaagtctttttttgcataacaacgttttgataaaatgaagagactgaccaaagtaacaactctaaataatrgcatttcactgccataaggatgattgtaattatcagtggaagcctagagcattaggtcccaactcctaatattagtttcaatttttatagcctggttgttcaaagacatgcaattaaactaacctagtattattggaatagaaaataaagaactactgttggaaacacaattaacaatacataatagaggggccatatttccaatggctgcatattaaaatcaacattgagctaaactaagcataggccaaagctgaatatcatcatcataggacatacttctaggattacaagagtgta

SEQ ID NO: 7926 - DNA, 601 bp, Human
gtgtttctgctggtgaagtcttcttcactctctggtgcttaagattagaaagaaaaaaggaaagtaactgaacaaaagaaattctttgaacatgaaattatcaaatgaaactgtacatatgcaaaggaattttaaaccattgccttgcaaagtctttttttgcataacaacgttttgataaaatgaagagactgaccaaagtaacaactctaaataatagcatttcactgccataaggatgattgtaattatcagtggaagcctagagcattaggtcccaactcctaatattagtttcaayttttatagcctggttgttcaaagacatgcaattaaactaacctagtattattggaatagaaaataaagaactactgttggaaacacaattaacaatacataatagaggggccatatttccaatggctgcatattaaaatcaacattgagctaaactaagcataggccaaagctgaatatcatcatcataggacatacttctaggattacaagagtgtatctgaaagtgactaccactttaatgatattaattttatcattaaaaggttttatggtcaaatttcaaaatcatggcattgta

SEQ ID NO: 7927 - DNA, 601 bp, Human
tctctggtgcttaagattagaaagaaaaaaggaaagtaactgaacaaaagaaattctttgaacatgaaattatcaaatgaaactgtacatatgcaaaggaattttaaaccattgccttgcaaagtctttttttgcataacaacgttttgataaaatgaagagactgaccaaagtaacaactctaaataatagcatttcactgccataaggatgattgtaattatcagtggaagcctagagcattaggtcccaactcctaatattagtttcaatttttatagcctggttgttcaaagacatkcaattaaactaacctagtattattggaatagaaaataaagaactactgttggaaacacaattaacaatacataatagaggggccatatttccaatggctgcatattaaaatcaacattgagctaaactaagcataggccaaagctgaatatcatcatcataggacatacttctaggattacaagagtgtatctgaaagtgactaccactttaatgatattaattttatcattaaaaggttttatggtcaaatttcaaaatcatggcattgtaatgtagggtgaaagttcctcagcactgc

SEQ ID NO: 7928 - DNA, 601 bp, Human
taaactttataacagagaagactttgcagcaggtaattgagtattatgatttccaatgctgaagtacaataaaagagtttggctaagcatcttggctaaggcctaacattagtgttttcctaatatgattcataaaacattcttttctaataaaaacaatctatttggctgctactttggacaccttgaaatcaaagaagattaaatattccattaataatgttaaattagtaaagtaggaaatggtccaattgttcaaatctttgcctattttccaagttaaaaaataagccactaaggmaacaaagaagaaataatcagagatagaaaggcattcagaaaatagtgtgtcagggaagacaaagatagtttttcaaagaaaaaataactggccaacagcatcataatcagcgcagtctaattaaacaaatatagactaccgttcttgtatccacagcacaaatgtcattgtcaacgttgaaaagaataggttcagggagtaatgacagcaaaagtttggaaggggagaaccattaatgggtggggaggaaggagaaacagcaggcataggctactctttccagaagcttgggttgggaag

SEQ ID NO: 7929 - DNA, 601 bp, Human
tgttttcctaatatgattcataaaacattcttttctaataaaaacaatctatttggctgctactttggacaccttgaaatcaaagaagattaaatattccattaataatgttaaattagtaaagtaggaaatggtccaattgttcaaatctttgcctattttccaagttaaaaaataagccactaaggcaacaaagaagaaataatcagagatagaaaggcattcagaaaatagtgtgtcagggaagacaaagatagtttttcaaagaaaaaataactggccaacagcatcataatcagcrcagtctaattaaacaaatatagactaccgttcttgtatccacagcacaaatgtcattgtcaacgttgaaaagaataggttcagggagtaatgacagcaaaagtttggaaggggagaaccattaatgggtggggaggaaggagaaacagcaggcataggctactctttccagaagcttgggttgggaaggaaaggataaaacaagaaataggtacgtaagtcttagaattgagaaaggttgctttcatgtttgcttttgttttttagaagaagaaataggtaggaatggttttaggttgag

SEQ ID NO: 7930 - DNA, 601 bp, Human
attctgctgccttttgtttggctatgccccgcccccagaggtggagtctacagagacaggcaggcctccttgagctgcggtgggctccacccagttcaagcttcctggccgctttgtttaccttctcaagcctcggcaatggcgggcacccctccccgagccttgctgctgccttgcagtttgatctcagactgctgtgctagcaatgagcaaggctccatggtcataggaccctccaagtcaggcgcgagatataatctcctggtgtgccgtttgctaagaccattggaaaagcgcagtrttaggaaaagtgacccgattttccaggtgctgtcttttatccctttctttgactaggaaagggaattccctgaccccttgtgcttcccgggtgaggcgattcctcaccctgcttcagctcacactcggtgcgctgcacccactgtcctgcacccactttccaacacccctcagtgagatgaacccggtacctcagttggaaatgcaaaaatcgcccatcttctgcgtcgctcacactgggagctgtagactggagctgttcctatttggccatcttggccccacccctatgctgtgctgc

SEQ ID NO: 7931 - DNA, 601 bp, Human
ttggtgcaattgcagtgggctacaagggatactcatgattttggttttcattgtcgaggtggtggttacatggctttaatttcattattgggtgttaaacgataggtagggtttatatatacactttagtgtgcatgatattgtggaacaaaacaattcacatggcagaaatgaaacaaatgaaaatgaacattttaagggtccaaaatcgaagtaagaaaataacagaataaacctaaaaaagtaaagaaagataatgaaaacaaacaaaaatgatagaaataatttaaaaagtcaaatrttaagtctttgtatagtcttcctgcaaacttaattttaaaaactaacaaactcataacagaacaaacaaaggtgaaaagcaacagacaaacctaacagaaaagcaacaaagaaaaaattggtaaatatattaagaatgaaactgtatacattaactatagaattagcatagaattaagaatatagcaagcaacttttatctagcaagcttataaatttagatgaatctcaatttcccagaaatattttttaatctgactcaaaaagagatagaacatgttaaactatcaggaattaaata

SEQ ID NO: 7932 - DNA, 601 bp, Human
attttaaaaactaacaaactcataacagaacaaacaaaggtgaaaagcaacagacaaacctaacagaaaagcaacaaagaaaaaattggtaaatatattaagaatgaaactgtatacattaactatagaattagcatagaattaagaatatagcaagcaacttttatctagcaagcttataaatttagatgaatctcaatttcccagaaatattttttaatctgactcaaaaagagatagaacatgttaaactatcaggaattaaataaggtggctaataatcacaactgttttcatatcktactgaagatgctaccaagtgaagtcaaagtagcatagcaatgtgaaggaaaaacaattctcaaatattttagtatcagtagatctctataattttagaaagaaaagaataataaaaccagagaaaataaaacacaaaataaaatcctattgattactaaaaatatctcttggaaatcttacaacaaaagtcaaacccagactgcagaccaccaagattacaaaaataatgaaaatcctgaatatcagaaatgtgtttgtgtctatataacctatttatattgtttattgacttagcact

SEQ ID NO: 7933 - DNA, 601 bp, Human
cttaacacctctttggaagtatacaaaaagagtgttgcaaataaaaaaatctttatgcatgtaaatattaaagcctagatgaaatggatgtctgggaagggtagtggggagggaactgagatggttaatgggtacaaaaatataattacatagaacaaataagatctagtatttgacagctcaacaggatggctacagtcaaaaataatttattgtacatttttaaataactaaaatattggattgttttttaatacggagaaaggataaatgtttgacgtgatagatctgcatttaccckgatatgactattatgcgttgtatgcctgtatcaaaatatctcaggcaccctataaatacatacacctattatgcacccacaacaatgaaaaagaaaaattgctttcttacattaaatatatgtatatatctctgtgtgtgtgtatatatatatgtgtatatatatacacacatgtatatacacatacacacacacacaaaaagagataaagcaaactctaaaaaggtttattaaccatagttaccattttagatgtttaaaagtcttgttaccaccaagtgcttaaaacaagacaaagtg

SEQ ID NO: 7934 - DNA, 601 bp, Human
atggttaatgggtacaaaaatataattacatagaacaaataagatctagtatttgacagctcaacaggatggctacagtcaaaaataatttattgtacatttttaaataactaaaatattggattgttttttaatacggagaaaggataaatgtttgacgtgatagatctgcatttaccctgatatgactattatgcgttgtatgcctgtatcaaaatatctcaggcaccctataaatacatacacctattatgcacccacaacaatgaaaaagaaaaattgctttcttacattaaatatrtgtatatatctctgtgtgtgtgtatatatatatgtgtatatatatacacacatgtatatacacatacacacacacacaaaaagagataaagcaaactctaaaaaggtttattaaccatagttaccattttagatgtttaaaagtcttgttaccaccaagtgcttaaaacaagacaaagtgtttcacagataaacattataaaacttttaagaataagtttagttccttcttaaattctgttagaatgtagaaaagaaggtcaatttccaaagtttattcttcaaggctgcaaaacattga

SEQ ID NO: 7935 - DNA, 601 bp, Human
aattacatagaacaaataagatctagtatttgacagctcaacaggatggctacagtcaaaaataatttattgtacatttttaaataactaaaatattggattgttttttaatacggagaaaggataaatgtttgacgtgatagatctgcatttaccctgatatgactattatgcgttgtatgcctgtatcaaaatatctcaggcaccctataaatacatacacctattatgcacccacaacaatgaaaaagaaaaattgctttcttacattaaatatatgtatatatctctgtgtgtgtgtatatatatatgtgtatatatatacacacatgtatatacacatacacacacacacaaaaagagataaagcaaactctaaaaaggtttattaaccatagttaccattttagatgtttaaaagtcttgttaccaccaagtgcttaaaacaagacaaagtgtttcacagataaacattataaaacttttaagaataagtttagttccttcttaaattctgttagaatgtagaaaagaaggtcaatttccaaagtttattcttcaaggctgcaaaacattgactatatccccagataaatatgac

SEQ ID NO: 7936 - DNA, 601 bp, Human
tgacagctcaacaggatggctacagtcaaaaataatttattgtacatttttaaataactaaaatattggattgttttttaatacggagaaaggataaatgtttgacgtgatagatctgcatttaccctgatatgactattatgcgttgtatgcctgtatcaaaatatctcaggcaccctataaatacatacacctattatgcacccacaacaatgaaaaagaaaaattgctttcttacattaaatatatgtatatatctctgtgtgtgtgtatatatatatgtgtatatatatacacacaygtatatacacatacacacacacacaaaaagagataaagcaaactctaaaaaggtttattaaccatagttaccattttagatgtttaaaagtcttgttaccaccaagtgcttaaaacaagacaaagtgtttcacagataaacattataaaacttttaagaataagtttagttccttcttaaattctgttagaatgtagaaaagaaggtcaatttccaaagtttattcttcaaggctgcaaaacattgactatatccccagataaatatgacaatacaaaacactataccaaactcactgga

SEQ ID NO: 7937 - DNA, 601 bp, Human
ctcaaattgatattccagttactgatcttgccattataaagccccttgacgctgattcaagagtctcatgtcttctgccagaatccgtgaaactgtggcaggctaatttgttagtttgaaagtaaggtgaaatctaatcccagtcccctttcacagttctcaacaaaagttctccaagatatattgtaggtggaaaaataaaccaaggctcagagcagtatgtatggtagagtaataaatttaagaaaactgataagtgtgtgcttgtggaagattaaacttcacattctttatcttgaakgtgcaaaggaaatatttcttttaattcctttctattttctctgatgtttctcatgagctttcttcctatttttcaactgctcactgaatgccaggaaaaaaaatagaacaaagcttaataaaacataacttagttcaagcctacttaaaacttagtgtgattcagtcatgtgaagaatatctttaggtttaattaacattcttcagaatacatgttccagtcttgttcttttatttgcttcatcgcttcttggatgcactggggtgtatggattttgctgaccctctgtcatcatgtagg

SEQ ID NO: 7938 - DNA, 601 bp, Human
tcagaagattaacatatgcttatgttattttatgcattataaacttggtaaagctattttccaaagtaaatattggtatgccaatgcaaaaggaagacaagatgtattatctagaatgattaaaaatgagatagtttgtaaatgtaaaactaagtgaagattatctatcatgacagattttcagaatgtggggtgatatagcccatgggtcaagagcagggagggcagccttgatgggggtggtgagttttgaactgatcatattttcatgggaagatattcctttttgtcgaagtgattkccaccactgttttcatgctctttcctcaatctccaagctccttggttttaaatggcttcaaaacagctgtgcatactggccactctagcaacctttccttaactgcatacctgagtacagtttgcagtccctttaccaaaatacatgatttctatgagagttctacttgctgaatgaactgtgtccagtgtttagtcctcaagaaaggagatggggcatcagaacagagagagagtatcatatcctgcaaaatattgcttggcttatggatttattctcaatttaatttttctgtctact

SEQ ID NO: 7939 - DNA, 601 bp, Human
ctacttgctgaatgaactgtgtccagtgtttagtcctcaagaaaggagatggggcatcagaacagagagagagtatcatatcctgcaaaatattgcttggcttatggatttattctcaatttaatttttctgtctactgatctaggtgtttttttttaaatagaatcaaaagtgacaattcatttgaaatatttctcccttgtccatgaattgctttgtaaatcttgtgagctacttcacgagttatgaagtttttaagaataaatagcaatgaactcactttagtctccatgccaaatgyagatgtttttgtgatagctgatcttgttttgtaggaaaactcttgccttcaagtccttctattggctttcaagagaataatttccttgttttaagtcagatcaagcaaactgtcaataatgtttattaactacccactttacaacagcttacagtggaggttccctagggagttagagttaatagaaaagtcattgcaattagaggatttacaataaagttaactcaaaatataaatgtttgttaattttgaactgagtgagaaggaaagaaaaataaattattgcaatcttctcctttt

SEQ ID NO: 7940 - DNA, 601 bp, Human
ctagggagttagagttaatagaaaagtcattgcaattagaggatttacaataaagttaactcaaaatataaatgtttgttaattttgaactgagtgagaaggaaagaaaaataaattattgcaatcttctccttttcagttgggtgaggagaagataacattccaaagaattgagtgatcataacatttgtagatcataaggtgattattggtaatctttgtgttagccatttcacaaatttatttgaaggagcagtaaaaatgttctctctgtctatgaaacatcttctcctcaggcatratttgtcagctttgtgtgggggattctttacacagcccactggaattcagtgatgcaatgttgttagtaggagaggactgacatttttttcagacaaagaaagtggtcttgttttttagacaacaaactttggggaatggaggaatcccaagtagaattagaaagagaagtcatggagagacatttggcctgttacttagtgattgcctcagctgtgtgtttcattatatgggagatttctattgcttttctttcctactgcctttagacacatgttagcaaggagaaatatatactttt

SEQ ID NO: 7941 - DNA, 601 bp, Human
ttttgattacacatcaaaagtgaaacttacacatacatgcatattcatttataatttatataggcatattttacgtcaatatgttgtgcacataaaatgtacaaaataaccatttttaaagataaaacaaaaataaggatatgtattaattctagtgttttcttcttgtatcccaaatatttttttttgtactccctcaacgagggccctatattttggaaaccaccagtgtgtatcaggacctttgctctgaagatgaaaaacacagaaaaattaatttttgctgttggttatgtttctrttgcttttccaaaggcagctgatgtcaaggtataatatggatatgggaaggggtggcgtttaggaatcttaaaataatacacagacaacgcacacaagaaaatatatatgcatgtatttaagtatctacatatatgtatgtgtatatatatgcatgtatttaagtgttttgtgtgtgtgtgtgtatgttttatatagataaaacattggttagcactttaaagtctttaaattcttatctggctccaattggttttgaattcatctgttagtaggtttgtctgttagttttgtggacatt

SEQ ID NO: 7942 - DNA, 601 bp, Human
ttctaagtgctttgtgcgtactgacttattccatacatttaacagctctatgggagaggggctatcattagctcctttttcacaaaggaagacacagagataatgagaggtgttatgagttgaactgggtctccccaaaagatgtgttgaagttctaacacccagtacctcaggatgtgatcttatttggaaattgggccttgcagagataatttattaagttgagatcatactggagtagagtgggtccttaatctgatatggctggtatccttataagaagaagaaaagaagctgggcrcggtggctcatgcctgtaatcccagcactttgggaggccgaggcaggcggatcccctgaggtcgggagttcgagaccagcctgaccaacatggagaaaccctgtcactactaaaaatacaaaatagccaggggtggtggcacatgcctgtaatcccagctactcgggaggctgaggcagaattgcttgaactccagaggcggaggttgtggtgagccgagattgtgccattgcactccagcctgggcaacaagagggaaattccgtctcaaaaaaaaaagtagaagaagaaaagagacac

SEQ ID NO: 7943 - DNA, 601 bp, Human
actactaaaaatacaaaatagccaggggtggtggcacatgcctgtaatcccagctactcgggaggctgaggcagaattgcttgaactccagaggcggaggttgtggtgagccgagattgtgccattgcactccagcctgggcaacaagagggaaattccgtctcaaaaaaaaaagtagaagaagaaaagagacacagagacatgactggagaaggccatgtaattggagtgattggagaggcaaagatctgagtgatgcaactgtgagctgagaaactccaagaaatgtaggtcactgccrgaagccaaaataaggcaatgaaggattctactcagagtctcaagagaccctggtcctgttcgcaccttggttttggacttcgagtctccagaaatatgagacaaaacatttttgttgtctggagttactcaatttgtgggactttgttatggcagttcttaggaaactaatatgatggattaaatagttgcctaaagttacatagtgagcaagtcatacaagcagaatttgagtcaagcagtctgtcattggagcctgcactccacagccctgccttatccctcctcaggggacagacag

SEQ ID NO: 7944 - DNA, 601 bp, Human
agacatgactggagaaggccatgtaattggagtgattggagaggcaaagatctgagtgatgcaactgtgagctgagaaactccaagaaatgtaggtcactgccggaagccaaaataaggcaatgaaggattctactcagagtctcaagagaccctggtcctgttcgcaccttggttttggacttcgagtctccagaaatatgagacaaaacatttttgttgtctggagttactcaatttgtgggactttgttatggcagttcttaggaaactaatatgatggattaaatagttgcctaaakttacatagtgagcaagtcatacaagcagaatttgagtcaagcagtctgtcattggagcctgcactccacagccctgccttatccctcctcaggggacagacagagcggtgccatgctgatgcacagctcctgctggggcatgaggaataaggctgtgggcagagatttttccttaggcaaccagtggaacttaggatgaagaacgcagcactgtcagatgaagaatattattaatgtttatcaaagatgcacattcaagatttctgaaaaacattttcaacactggaaggcatgttaaat

SEQ ID NO: 7945 - DNA, 601 bp, Human
ataaagtttatagccttgctgatctccttggcatatgcttacatacatatgtgaatacatagacacacatatatgcacatataaatgtgcatgtcgttcttcatttaaccagattccttgtgcccctgtattaaaaatggtcaagtttctatttcaaaccatgcaataattataatatcagataaagaattctttcacaatcttttcttagaattctagatgtgacttagtttccttcctctacagtgagggaggaaataagagtgatttgtgaagatgcatattttttttcagtaaaacwggggaggtttcacttatctcgggtctcctattctggatacaacatttcaagagtcttggattcctgtttgattatcaagttcacttccactgaccaataaatattggtagatgttaagttctcaggcttgagaggcttctgtcatttggtgtgtccgatgctaacagacactcttaaataaaatgcctcatgaggggccgggcacggtggctcatgcctgtaatcccagcactttgggaggccgaggtgggcggatcatgaggtcaggagattgagaccatcctggctaaaatggtgaaa

SEQ ID NO: 7946 - DNA, 601 bp, Human
catttcaagagtcttggattcctgtttgattatcaagttcacttccactgaccaataaatattggtagatgttaagttctcaggcttgagaggcttctgtcatttggtgtgtccgatgctaacagacactcttaaataaaatgcctcatgaggggccgggcacggtggctcatgcctgtaatcccagcactttgggaggccgaggtgggcggatcatgaggtcaggagattgagaccatcctggctaaaatggtgaaacgatgtttctactaaaaatacaaaaattagccaggcatggtgrtgcactcctgtaatcccagctacttgtgagactaaggcaggagaattgcttgaattcgggaggcggaggttgcagtgagccgagatcgcgccactccagcctgggagacagagcaaaactccgtctcaaaaaaaaaaaaaaaaaaaaaaaaaaagcctaacgagaaggtaaaagagcaaggaggaaactaaagcaaggattgcttttattgcaaaagaggtggaggaatctttaaagatttctgatacagcagaaaatcagatattgcatgttctcacttacaagagaatgagctaaaca

SEQ ID NO: 7947 - DNA, 601 bp, Human
aggtgggcggatcatgaggtcaggagattgagaccatcctggctaaaatggtgaaacgatgtttctactaaaaatacaaaaattagccaggcatggtggtgcactcctgtaatcccagctacttgtgagactaaggcaggagaattgcttgaattcgggaggcggaggttgcagtgagccgagatcgcgccactccagcctgggagacagagcaaaactccgtctcaaaaaaaaaaaaaaaaaaaaaaaaaaagcctaacgagaaggtaaaagagcaaggaggaaactaaagcaaggattrcttttattgcaaaagaggtggaggaatctttaaagatttctgatacagcagaaaatcagatattgcatgttctcacttacaagagaatgagctaaacaatgagtacacagggacataaagatagacataagatactgaggactccagaaacggggagggagggagaaggtggaggttggaaggttaccttttggatataatgttcattatttggatgatgggtacactagaagctcagtccccaccattaggcaatatacccatgtaacaaacatgcactgctaccccctgaatctaaat

SEQ ID NO: 7948 - DNA, 601 bp, Human
ggagaattgcttgaattcgggaggcggaggttgcagtgagccgagatcgcgccactccagcctgggagacagagcaaaactccgtctcaaaaaaaaaaaaaaaaaaaaaaaaaaagcctaacgagaaggtaaaagagcaaggaggaaactaaagcaaggattgcttttattgcaaaagaggtggaggaatctttaaagatttctgatacagcagaaaatcagatattgcatgttctcacttacaagagaatgagctaaacaatgagtacacagggacataaagatagacataagatactgrggactccagaaacggggagggagggagaaggtggaggttggaaggttaccttttggatataatgttcattatttggatgatgggtacactagaagctcagtccccaccattaggcaatatacccatgtaacaaacatgcactgctaccccctgaatctaaattttttaaaaaagatttctgacaaatagagtcttagaactgaaagctagaaggtgacaaagagaacggagaatgtctgtcatcaaatctagtggtcttccctttctctcgttcccttctcaggacacctgagatatgcc

SEQ ID NO: 7949 - DNA, 601 bp, Human
ctattcattacagcagacctaccctaaataaatgtaaaggaagttctttagacaaaaggaatgtgatacttgacaaacttgaatctacacaaagaaatgaagagcaatgaaaatggaataaattaaagtgtaatagcattatagttttatttttagttgctctaaaaataactgactgtctaaaacaaaattaatggcagtagattgtgtgtctataggaaatgtgtgtgtgtttatgcaaaaataaaatggcacaaagaatgggaggaaagagctgggaatttaatgttttaactcttasagttttaactctttcctagaattacatataaagtggtacaatattatttgaatgtaaactctggttggttaaagatatataatgtatacactaggacaaccactaaaaatcaaagtatacaaatagcagaggaaatagaataaaaaataatgctcaataaacaaaacagaaagcagaaaaaagaggcaaaaacaagaactgataaagctaataaaaattgcttagaaagttggtagatttatatccagcagtgtaaaaaatcatgttaaatgtgatctctttaaactcaccagttaaaag

SEQ ID NO: 7950 - DNA, 601 bp, Human
gcacaaagaatgggaggaaagagctgggaatttaatgttttaactcttacagttttaactctttcctagaattacatataaagtggtacaatattatttgaatgtaaactctggttggttaaagatatataatgtatacactaggacaaccactaaaaatcaaagtatacaaatagcagaggaaatagaataaaaaataatgctcaataaacaaaacagaaagcagaaaaaagaggcaaaaacaagaactgataaagctaataaaaattgcttagaaagttggtagatttatatccagcartgtaaaaaatcatgttaaatgtgatctctttaaactcaccagttaaaagatagagattgtcagattgtataaaaactgagacacgactaatctataagaaatgactttaagacattgacaggttaaatataaatgaatgggaaaggtattctatgcaaacacccgtcaaatgaatactggatcaactatactgatgatagacaaagtaggctttaggacaagaaataatatcaaggataaagagagatattacacaatgaaaaagtaattatatcctaagttttaaaatgctaagtatat

SEQ ID NO: 7951 - DNA, 601 bp, Human
caccagttaaaagatagagattgtcagattgtataaaaactgagacacgactaatctataagaaatgactttaagacattgacaggttaaatataaatgaatgggaaaggtattctatgcaaacacccgtcaaatgaatactggatcaactatactgatgatagacaaagtaggctttaggacaagaaataatatcaaggataaagagagatattacacaatgaaaaagtaattatatcctaagttttaaaatgctaagtatatatacacataaagcatttcaaaatacataaatttaaaraatgacagactgaaaggggaaaaaatccacaattgtagtcaatgtcaatactcctttctcatagtcgacagaacaagtagatagaaaattagtgaggatatagcaaacctgaacaaaactatattaccagcttgaccaaattgacatttatagaacagcagaagatacattattttaaaatgcacaaggaaaattgaacaagatagatcatcttctgggtcataatagaagccttcagaaatttaaaagaaactgtattatcatataataatgtgattaaactagaaattacagaaatag

SEQ ID NO: 7952 - DNA, 601 bp, Human
tgaaattgaaaagagaaaaacaataaagaaaatcaataaaaccaaaagctgattatttgaaaataacaataaaattgatttatttttaagcagactgatcaagaaacatacaggacatacaaatattaccagcatcagcatgaaataacatacataatatccaacactatgcatgttaaaaagatagtaagcttatgatataagcaagtctatgcctgttaagttcaggaatttaaatgaaatgggccaagtccttgaaagacacaatctgccaaaaatcaattaaaaagaaatagatgayttgaatagccaatattggtcaagcaaagtgaatcatagttaaacatttgtaaaaatgaatattctaggctccaatgattttactagcaaattctaccaaacccttaaggataaaataatgctgattctatactacctcttccaaaaactaggagattagagaatacatttcaaatcatttcactagggcaaaattttccttatcctaaaagtagacaaagaccttacaacaaacaaaactgcatgccagtatgatttataaacatagaacaccaaatctttaatagaatattagcaaatg

SEQ ID NO: 7953 - DNA, 601 bp, Human
aattaaaaagaaatagatgacttgaatagccaatattggtcaagcaaagtgaatcatagttaaacatttgtaaaaatgaatattctaggctccaatgattttactagcaaattctaccaaacccttaaggataaaataatgctgattctatactacctcttccaaaaactaggagattagagaatacatttcaaatcatttcactagggcaaaattttccttatcctaaaagtagacaaagaccttacaacaaacaaaactgcatgccagtatgatttataaacatagaacaccaaatctktaatagaatattagcaaatggaatccaatatataaagaaatatataaaaatataatacttattaccaaccaaatgaggtatatctcaagatgcaaggctggtacaacattaaaaaatcaaccaatgtatttcactgtagtcacagactaaatattgttaagatggcaattctctctacttttatctatagattcaatgcaatccctatcaaaatctgtgcaagcttttttgctgatgtcaacatactgattctagactttatatagaaaatcaaaggaactacaagagctgaaataattt

SEQ ID NO: 7954 - DNA, 601 bp, Human
ccctcaggtcctccagaactaaccaacccgatttcaggttccagtcttcatcactgtgagagaataaatttctgtttttttaagccaccaagtttgtggtgctttgttatggaagattcaggaaactaacacataacaaataaattattttgaaaaatgaggtgttttttgaagccatgttattgacactgtaatggagattaccttgccacaataatatagcaacctaatcccccgaggtctgctaaagctcttactaaccttagaaaaaattgtaaacaatagtctgaatactattttktaaatatatatttatctttaaacaaggttacacaggctatttgataattcttgacagtcagaaatcaattcctattcaatgagttttcctaaatggaagaaaatgaatcatggaacccttactgggcataaagcttagaaagaatgtaaaggcagatggccctgtctgacattagctgtcatctttgcctccaaacagatgctaaggaagaagctgaaaacacattacagtgtctgacacagtgttagtctaagcatgtgcctaagatgctaatacaggttatgagaaaaggggcctcgt

SEQ ID NO: 7955 - DNA, 601 bp, Human
acaggctatttgataattcttgacagtcagaaatcaattcctattcaatgagttttcctaaatggaagaaaatgaatcatggaacccttactgggcataaagcttagaaagaatgtaaaggcagatggccctgtctgacattagctgtcatctttgcctccaaacagatgctaaggaagaagctgaaaacacattacagtgtctgacacagtgttagtctaagcatgtgcctaagatgctaatacaggttatgagaaaaggggcctcgtagccaaagttttgcaaattctaagctaaaaamattaaaaatatttttcatgataggatatatgaggctcattagtgtgctgatatatatcgtgacacattagaacagaagatagcagactcttttccatgtttattttaccctagaatcttctgtgaagaagtttcatgaaactgagcctccatgaactcacttcaggggataagcaacttagaatattgcttctattgatgcgtcattgggtcaatttggaagggatggatctctccctatcctgtatacattttgtttattttccccctttctttctatttttaaccatctcacctttaa

SEQ ID NO: 7956 - DNA, 601 bp, Human
acacattacagtgtctgacacagtgttagtctaagcatgtgcctaagatgctaatacaggttatgagaaaaggggcctcgtagccaaagttttgcaaattctaagctaaaaaaattaaaaatatttttcatgataggatatatgaggctcattagtgtgctgatatatatcgtgacacattagaacagaagatagcagactcttttccatgtttattttaccctagaatcttctgtgaagaagtttcatgaaactgagcctccatgaactcacttcaggggataagcaacttagaatattkcttctattgatgcgtcattgggtcaatttggaagggatggatctctccctatcctgtatacattttgtttattttccccctttctttctatttttaaccatctcacctttaaaaagatgttcctttgacccacaaattatttcccatctctactgtgtatactttaggatctaagatgtcctatttaatataaaatttaaaaaatcacattgagtagtcttttattcctgattcaccaaattactgctaccataatgctttatcttctaaatcatttctattttctttactgtttattgg

SEQ ID NO: 7957 - DNA, 601 bp, Human
actcttttccatgtttattttaccctagaatcttctgtgaagaagtttcatgaaactgagcctccatgaactcacttcaggggataagcaacttagaatattgcttctattgatgcgtcattgggtcaatttggaagggatggatctctccctatcctgtatacattttgtttattttccccctttctttctatttttaaccatctcacctttaaaaagatgttcctttgacccacaaattatttcccatctctactgtgtatactttaggatctaagatgtcctatttaatataaaattwaaaaaatcacattgagtagtcttttattcctgattcaccaaattactgctaccataatgctttatcttctaaatcatttctattttctttactgtttattggtgtggaaccataagaaacagctgatattcaacttatgaaagtggcaattccatatggttcaaccaaatacattaatgttattaaagagtcaacacagtttccaagatagttgatttatcaaagagccttaaccactgcaagaatttggcttaatgcttttataaataggctaggtggttgacaggtgagatcacttat

SEQ ID NO: 7958 - DNA, 601 bp, Human; identical to SEQ ID NO: 3157

SEQ ID NO: 7959 - DNA, 601 bp, Human; identical to SEQ ID NO: 3158

SEQ ID NO: 7960 - DNA, 601 bp, Human; identical to SEQ ID NO: 3159

SEQ ID NO: 7961 - DNA, 601 bp, Human; identical to SEQ ID NO: 3160

SEQ ID NO: 7962 - DNA, 601 bp, Human; identical to SEQ ID NO: 3161

SEQ ID NO: 7963 - DNA, 601 bp, Human; identical to SEQ ID NO: 3162

SEQ ID NO: 7964 - DNA, 601 bp, Human; identical to SEQ ID NO: 3163

SEQ ID NO: 7965 - DNA, 601 bp, Human; identical to SEQ ID NO: 3164

SEQ ID NO: 7966 - DNA, 601 bp, Human; identical to SEQ ID NO: 3165

SEQ ID NO: 7967 - DNA, 601 bp, Human; identical to SEQ ID NO: 3166

SEQ ID NO: 7968 - DNA, 601 bp, Human; identical to SEQ ID NO: 3167

SEQ ID NO: 7969 - DNA, 601 bp, Human; identical to SEQ ID NO: 3168

SEQ ID NO: 7970 - DNA, 601 bp, Human; identical to SEQ ID NO: 3169

SEQ ID NO: 7971 - DNA, 601 bp, Human
ctggtctcctgaaagtttgccagcaaagggagataaaagaactgtcccatttaattatgagtgtgcaacttcaaaggcttctccagactgactggggaaagcctgctgctaaatcttcccattgcagaagggtttccctcttctgataatctcttgtgctccagaggatttcctaaacattttgtgaacactattctcttgagggtatttttttctattattaattatacatgctcatgttcttcattatcattgctgtcaacacagtggtaataaaagagctcatgactagtgagtggcktctgtgttccaaagagatgatgagaatagtggggaagaggcctgttggagattttaattaggatgatgtggctcttcacagtggtggtgatgtagggctcatgaattgcaggaggctattggatcacagtgcatgtgggttttatcctaaaaaaaataggcttgcaggtaaagaaagatgagaggggcattccaagcagaaggaacagagggatagaatctgtgtataggaccagactcagtttgaaattaccagaatgcagaattaaggaagcatgtggtaaaaggtaaagttggttga

SEQ ID NO: 7972 - DNA, 601 bp, Human
aagcctgctgctaaatcttcccattgcagaagggtttccctcttctgataatctcttgtgctccagaggatttcctaaacattttgtgaacactattctcttgagggtatttttttctattattaattatacatgctcatgttcttcattatcattgctgtcaacacagtggtaataaaagagctcatgactagtgagtggcttctgtgttccaaagagatgatgagaatagtggggaagaggcctgttggagattttaattaggatgatgtggctcttcacagtggtggtgatgtagggmtcatgaattgcaggaggctattggatcacagtgcatgtgggttttatcctaaaaaaaataggcttgcaggtaaagaaagatgagaggggcattccaagcagaaggaacagagggatagaatctgtgtataggaccagactcagtttgaaattaccagaatgcagaattaaggaagcatgtggtaaaaggtaaagttggttgagaaacaagaactggggggctttttaccttcctgcagacccaggttttattctaaaggcaatgaggagctaatgatggttttaggcaatagagtgctgt

SEQ ID NO: 7973 - DNA, 601 bp, Human
tagtcttggagtgcttactctaggctgagcaggtgaagtgtcattaaggaggctgcactggaatctaattttccacctcacctattcccctccaacccctcttccctgttttcctttttctcacattttcctttctttcataccctatgagattccacacagtgggtatggacaggtaggggtaggaagaggtgatggcacaattggctgtagtttgaacaagaaaacatcaatctattattgtgattttatgattcgctggttgaagtgaattgaacatggccagctttccacagcttgrctcccacacttagaatgaggaattgaggaaagaggaagaaactcatatttacagagactctactctattggacccttgctgagttcttttataaacctcattccattttatgtacacactaactcagagagggaggcattattgtctatagtttagcagaagagaaaatacattcagagaaattaagtaacttgataaagttcacactgccataaaagtgtcatctgaaaacacatatagcctgactactcatgtaacttaatctccaggtgatgcaaatacaattctccagttttactt

SEQ ID NO: 7974 - DNA, 601 bp, Human
caggtaggggtaggaagaggtgatggcacaattggctgtagtttgaacaagaaaacatcaatctattattgtgattttatgattcgctggttgaagtgaattgaacatggccagctttccacagcttggctcccacacttagaatgaggaattgaggaaagaggaagaaactcatatttacagagactctactctattggacccttgctgagttcttttataaacctcattccattttatgtacacactaactcagagagggaggcattattgtctatagtttagcagaagagaaaatacrttcagagaaattaagtaacttgataaagttcacactgccataaaagtgtcatctgaaaacacatatagcctgactactcatgtaacttaatctccaggtgatgcaaatacaattctccagttttactttatttttctgaggaagaactgtcctctgggtactcagatttttttaaaataaaactaagcttctctgaacatcattacaatctggagcagacatcaacctctgcagtatttcatcattcttacagaatctgtagaattctatatactgtatggtattatgcttattagtctt

SEQ ID NO: 7975 - DNA, 601 bp, Human
aacagcaccatgccgaatctttcatctctatttcattgatcttctgcctacacagtttaaaggaatactggttagaagtaatgaaactaaaacctgcaggcttaacatacacataaatttgacaaaccagcatggaagcattgcatttcagatccatgtggcaaattgatctttttttagttctgtcatttgaaagataaagcaatttgagataaggcccagaaaagatagtggcacatcagatgaaggacacaagtctcctgatttcttcttttatgaccttttcactatttgtctattaaaaaaaaaaaaaacctgatgtaatgttatggcagtctaaagggttttcatgctaaatagataccattatctctaaactcttctatatagcaaaacccaacattttcatcttcttgactttatctctaccaaatgattccttctttggcataacttttaaaattggaattgagaaactggtaaattcacaagaaaagttgcaattttgttttataattttctgtcttatctgaaaagcccaatacctgcctgagaatctggtaccaacacctgatatttctaagtgatttttaaactctac

SEQ ID NO: 7976 - DNA, 601 bp, Human
atgtcactcatatttaaatacctcttctttccttagcttgaacttgttcaattaatatcaaatcctggtggtaaagcatagaagacatatcagtggatgatttgaggaggaacattggccatcttgaactaaacaatgttctcccactttgatactttcctgtttagggctaaggtcttttatccttcagccaatcacagcaatgatacaatctcttaaattcatcccaatgtgcaagcaattggctgcaggtgtgttattgagaagattattgaggagtcatcacacacatgccaaagtwaggacacatatatattcttcccagctttgcttatagttggcaatgcctggaggtgaagcacgcatttagaagcatgatcctggagaatgttcatgatgttgcattaagtacacaggaaaagaggtgtgggagcttataggctgtattttccccctcatgtttgtagaagagcatcagaaatagcaatgggatataaaaataaagctgcaataatagaattatgttaggggaaaaaggttgagagaattaaaaactgagaaaaataaaatgataagaaaacagaacgtgcctatgggagaa

SEQ ID NO: 7977 - DNA, 601 bp, Human
tgtttgtccttaaccttacatgagggctggaaataaagaaagataggaacttctttgttttgttttttttgagttggaatttccctgtgtcacacaggctggcgtgcagtggcacagtctcggctcactgcaacctccgcctcctgggttcaagcaattctcctgcctagcctcccaagtagctgaaactacaggcatttgccaccatgcccagctaatttttgtatttttagtagagatggggtttcaccatgttggccaggctggtcttgaactcctgaactcaggttatctacctgcyttggccttccaaagtgctgggattatgggcgtgagtcaccacgtccgatgggaacttcttaaactgagatgaatgaatggcaaaagccatagaacccaacaacctatgaaatataattgttaataagcataaaccgttacaaaaattcccatactgtaaagtctaatcatattcatatgtcatgtatgtttattaataataacaattttcttttcctttcaactgaggtctagaacagataattatggcaacaatttgtcaaatagactctgttacatagcagatgatcaacaaatgagc

SEQ ID NO: 7978 - DNA, 601 bp, Human
aaactatagtaattaaaacagtatggtactaacacaaaaacagacacatagaccagtggaacagaatagacagcatagaaataaacccatacatttatagccaattgactttaaacaaagatgacaagaacacacaatagggaaaagacagtttattcgataaatggtgttgggacaactggatgtccacatgcagaagaaagaaattagagtcttatctcatactgtatataaaaatcaactcaaaatgaattaaagacttatatgtaaaacctgaaattttaaaactactcgaagaaaygtaggagaaaagctccatgccattggtcttagcaatgatttttttttggatataacaccagaacacagacaacaaaaacaaaaataaatgagtgggactgcattgaactaaaacgtttctacagcagcaaaggaaacaacagaaatgaaaaggcaacttctggaatgagagaaaatatttgcaaaccatatatccaataaggggttaatattcaaaatatatgagttctagtccatttttgcattgctacaaagaaatacctgaggctgggtaatttataaagaaaataaatttattttg

SEQ ID NO: 7979 - DNA, 601 bp, Human
aggaagcttctgatcatggctgaaagtggaggcagagctagtgcatcacatggcgagagagaggaagacagagggaacaaaagaggttgggaggaggcgccacactcttttaaacaatcagatcttacgtgaactaccagagcaggaactccctcatcagcaaaaggacagcattaagccattcattagggatctgcccccatagtcaaaacacctcccaccaggccccatctctagttttggggattgcatttccacgtgagatttggagaggacaaacgttgaaactatatctaactcrtacaactcaatagcaaaaaaaatcaaacaaccagattaaaaaaatgggcaaatgacctgaatagacatttttccaaagaagatatgcaaatggccagtgggtatatgaaaaaagtgcttaacatcactaatagggaaatgcaaatcaaaaccacaatgaaatatgacctcacaactgttaggatggctgttatcaaaaagtcaaaagatagatgttggcagggttgtggagaaaaggaaaacttccatgttgttggtgaggatgtaaattgatacagccattatggacgatactatggag

SEQ ID NO: 7980 - DNA, 601 bp, Human
ctaccagagcaggaactccctcatcagcaaaaggacagcattaagccattcattagggatctgcccccatagtcaaaacacctcccaccaggccccatctctagttttggggattgcatttccacgtgagatttggagaggacaaacgttgaaactatatctaactcatacaactcaatagcaaaaaaaatcaaacaaccagattaaaaaaatgggcaaatgacctgaatagacatttttccaaagaagatatgcaaatggccagtgggtatatgaaaaaagtgcttaacatcactaatarggaaatgcaaatcaaaaccacaatgaaatatgacctcacaactgttaggatggctgttatcaaaaagtcaaaagatagatgttggcagggttgtggagaaaaggaaaacttccatgttgttggtgaggatgtaaattgatacagccattatggacgatactatggagtttccttaaaaaatcaaaaagagaattatatgatctaggaatttctggatttatgtacaaaggaaattaaatcactatcttgaagagctgtctgcactcccatggtcactgcagcattactcctaataaccaa

SEQ ID NO: 7981 - DNA, 601 bp, Human
cactcccatggtcactgcagcattactcctaataaccaagatatgaaaacaacacaagtgtctgttgtaagatgaatgggtaaagaaaatgtgagatatatatctatatatgtaacatgatgttttgatatgcatatgcataatatgcatatatttacatatgtgtgtgtgtgtatatatatatctatatatacacaaatacccagtggaatagtattcgtcctttaagaaggaaatcctttcatttgccacaacatggatgaacctggaggacattctgctaagtaaaataagccagacrtagacaaaaaaacactgcacgatctcactcatatgtggaatctaaaaacgttgaactcttagaaatagagtagaagggtggttacccagggccaaggggtaggagaaatggggagactttgcatacaaactttcaaagttataagatgaatacgttctggagatctaatgtacagcatggttactatagtttgtaatactgtctacttgcattgtatgaggagagtacatcttagatattcccactgcacatagacacacacacaaagttaactgtgtgaggtgatggatatgtttatta

SEQ ID NO: 7982 - DNA, 601 bp, Human
gtaagatgaatgggtaaagaaaatgtgagatatatatctatatatgtaacatgatgttttgatatgcatatgcataatatgcatatatttacatatgtgtgtgtgtgtatatatatatctatatatacacaaatacccagtggaatagtattcgtcctttaagaaggaaatcctttcatttgccacaacatggatgaacctggaggacattctgctaagtaaaataagccagacatagacaaaaaaacactgcacgatctcactcatatgtggaatctaaaaacgttgaactcttagaaayagagtagaagggtggttacccagggccaaggggtaggagaaatggggagactttgcatacaaactttcaaagttataagatgaatacgttctggagatctaatgtacagcatggttactatagtttgtaatactgtctacttgcattgtatgaggagagtacatcttagatattcccactgcacatagacacacacacaaagttaactgtgtgaggtgatggatatgtttattatcttggttgtggtaatcatttcacaatgcatatgcatatctaaacatcatgttacatactttaaga

SEQ ID NO: 7983 - DNA, 601 bp, Human
tttggatataccacagtttatttatccatagaggaatcttagatgcatattaccaactgaaaaaaaaactgaaaggactacatatactgtatgactccaactatataacattaaggaaaaggcaaaattatggaggacagtgaaaagatcaggttgtcagggattggggaaaggtgtgggagagggacggatgactaggcagatcacagagggttttcagggcagtgaaattactgtgtatgagtagtgaattcatgtcactatatgtttactcacactcatacaatgtacactaagagtrgaccctaatgtcaactattcactttgggtaatagtgatgtgtcaatgtacgctcatcagttacagcaagtgtacttctctggtgggaattgttgataatggagaaggctatgcacgtgagggagaaggaggtatatggaatatctccgcatctctctcagttttgctgtgcacctaaaactgctctaaaaagaaaacagtcttaaaagaatatgtactctctctgatattgtttgttagcgtgctctataaatgttaattatgtctactgggctgttaatgtcaacttttctatatccat

SEQ ID NO: 7984 - DNA, 601 bp, Human
aggttgtcagggattggggaaaggtgtgggagagggacggatgactaggcagatcacagagggttttcagggcagtgaaattactgtgtatgagtagtgaattcatgtcactatatgtttactcacactcatacaatgtacactaagagtggaccctaatgtcaactattcactttgggtaatagtgatgtgtcaatgtacgctcatcagttacagcaagtgtacttctctggtgggaattgttgataatggagaaggctatgcacgtgagggagaaggaggtatatggaatatctccgcrtctctctcagttttgctgtgcacctaaaactgctctaaaaagaaaacagtcttaaaagaatatgtactctctctgatattgtttgttagcgtgctctataaatgttaattatgtctactgggctgttaatgtcaacttttctatatccatactgattttaatttcactaattgcattaattactgagaaaggagcgtttatatattaaaaagtagtctaaaaagcaaaaaaaaaaaaaaaaaaaatcctgcttcaaaaatacagttagtccttccctgtgactcccctccatgcaaatta

SEQ ID NO: 7985 - DNA, 601 bp, Human
tactgtgtatgagtagtgaattcatgtcactatatgtttactcacactcatacaatgtacactaagagtggaccctaatgtcaactattcactttgggtaatagtgatgtgtcaatgtacgctcatcagttacagcaagtgtacttctctggtgggaattgttgataatggagaaggctatgcacgtgagggagaaggaggtatatggaatatctccgcatctctctcagttttgctgtgcacctaaaactgctctaaaaagaaaacagtcttaaaagaatatgtactctctctgatattktttgttagcgtgctctataaatgttaattatgtctactgggctgttaatgtcaacttttctatatccatactgattttaatttcactaattgcattaattactgagaaaggagcgtttatatattaaaaagtagtctaaaaagcaaaaaaaaaaaaaaaaaaaatcctgcttcaaaaatacagttagtccttccctgtgactcccctccatgcaaattaattgccaaatccaccaaatactcctttccgttttttctttttttgttgttttttttgtttttttgttttttttgagacgga

SEQ ID NO: 7986 - DNA, 601 bp, Human
ggagaaggacaaattcatctagaagaacacgtgttccattcctcttgatttatcaaaataagaaatgcaatttcacttcccacatgagaataacaaagttaatatgaaatatgcttttgaagaagtcgtaattgacattattaccaattttgttcaagaaaggaaacaaagactttcttcacttgaacattagatcagaaatttaattttatgttgcgtttttcttttttaaaaaatatatgttaatagagatataattcacataccacaaaattcacataccactcagtattttgatatrttaacataattatgcagccatcaccactgtccagttccaaaaaaaaagtttatcatcataaaataccctgttaccctatagcagccactccccattctcttgtcccagaacccctggaaaccaccaatctactttgtctctatggacttgtctattctgagtattccatacaaatggaatcataaaatatgtgatcttctcgcatctggcttttttcacttagcataagtgtttgcaaggtttatcaaagttgtagcatatgtcagtccttcattgctttttatggctgaataatatcct

SEQ ID NO: 7987 - DNA, 601 bp, Human
gttaatagagatataattcacataccacaaaattcacataccactcagtattttgatatattaacataattatgcagccatcaccactgtccagttccaaaaaaaaagtttatcatcataaaataccctgttaccctatagcagccactccccattctcttgtcccagaacccctggaaaccaccaatctactttgtctctatggacttgtctattctgagtattccatacaaatggaatcataaaatatgtgatcttctcgcatctggcttttttcacttagcataagtgtttgcaaggkttatcaaagttgtagcatatgtcagtccttcattgctttttatggctgaataatatcctgttgtatggatacaccaccgttatttaacccttcatcagttaatgggcatttggacataggatttctactttttggtcgttatgaataatgctgctacaaacattcctgtgcgactttttgggtggacatgtcttttaatttctttggggtctgtatctgtgagtggaattgctgggtcatagagtgactctgttttaccttttgaggtagcacaggaccgtcttcaaaatgacaatacca

SEQ ID NO: 7988 - DNA, 601 bp, Human
tctaaattttttaatatgtagaacaagtaaaatgaaattattggggacttaatatattgatcttttataaactccactaggtttttcctcaaacatgcatgtttcctgtctttctggagattcactaacttatttagctaccattttttaagcaatagagtatgtttaaactttattttattaaaaaggtgttgagtaaatgtatagaattatgatttttaaaattgtttataattcatttcagcctcttgaagtactttaaaactaaataagcttcatcagtttccttacatgagcaaartaattttgcagggaatcatgacagtatgtaagatttttgaaaacgaaaaccaagaatttatgacagccagttgagtgcctttggtcaaggtcacggaccctttctttctcatagtgctacatctgcaaacacattggtactggatgttttgaagcaaatgaccagtatgaaaacttgtaaagagttcgttttgcaatttatgaatgaaaactgcagctgtggttacatgagttaggaaagcaattataagacccatcagtttctcaatcctgacagccgccatcacctcaccagctggaa

SEQ ID NO: 7989 - DNA, 601 bp, Human
gtgtatatgtgtatatgtgtatatacatatatgcgtatatgtgtatatgtgtatatatgtatatgtgtaaatatacatgtgtatatgtgtatatatacatatgtgtgtgtatatgcgtatatatgcacatatagacataggcatgtgtgtatatgcgtatatatacacatatagacataggcatgtgtgtatatgcgtatatatacacatatagacataggcatgtgtgtatatgcgtatatatacacatatataggcatgtatatatgcatatgcgtatatatatacacatatctagacrtgtatgtgtgcatatgcgtatatatacacatatatgggcatgtatgtgtgtatatgcgtatatatacacatatatagacatatgtatatgcgtatatatacacatatatagacatatgtatatgcgtatatatacacatatatagacatgtatatgcgtatatatacacatcatagacatatgtatatgcgtatatatacacgtatttagacatatgtatatgcgtatatatacacgtatttagacacgtacgtgtgtatatgcgtatatatatacacgtatgtagacatgtatgtgtgt

SEQ ID NO: 7990 - DNA, 601 bp, Human
gcacatatagacataggcatgtgtgtatatgcgtatatatacacatatagacataggcatgtgtgtatatgcgtatatatacacatatagacataggcatgtgtgtatatgcgtatatatacacatatataggcatgtatatatgcatatgcgtatatatatacacatatctagacatgtatgtgtgcatatgcgtatatatacacatatatgggcatgtatgtgtgtatatgcgtatatatacacatatatagacatatgtatatgcgtatatatacacatatatagacatatgtatatscgtatatatacacatatatagacatgtatatgcgtatatatacacatcatagacatatgtatatgcgtatatatacacgtatttagacatatgtatatgcgtatatatacacgtatttagacacgtacgtgtgtatatgcgtatatatatacacgtatgtagacatgtatgtgtgtatgcgtatgcacgtatgtagacatgtatgtgtttatgcgtatacacgtatgtagacttatgtatgtgcgtatatgcgtgtacacgtatgtagacatatgtatgtgcgtatatgtgtgtacacgt

SEQ ID NO: 7991 - DNA, 601 bp, Human
catatagacataggcatgtgtgtatatgcgtatatatacacatatagacataggcatgtgtgtatatgcgtatatatacacatatagacataggcatgtgtgtatatgcgtatatatacacatatataggcatgtatatatgcatatgcgtatatatatacacatatctagacatgtatgtgtgcatatgcgtatatatacacatatatgggcatgtatgtgtgtatatgcgtatatatacacatatatagacatatgtatatgcgtatatatacacatatatagacatatgtatatgcgaatatatacacatatatagacatgtatatgcgtatatatacacatcatagacatatgtatatgcgtatatatacacgtatttagacatatgtatatgcgtatatatacacgtatttagacacgtacgtgtgtatatgcgtatatatatacacgtatgtagacatgtatgtgtgtatgcgtatgcacgtatgtagacatgtatgtgtttatgcgtatacacgtatgtagacttatgtatgtgcgtatatgcgtgtacacgtatgtagacatatgtatgtgcgtatatgtgtgtacacgtgtg

SEQ ID NO: 7992 - DNA, 601 bp, Human
atcggttccccatataaaatgtagggaatgtggttaagccaagataaacaaacacagcaaaaatcatgtttacataatttatattttgtattatatacataatttataaatgccataatttatattcttgtagcaggattcatgtacaaatctcttagtattgattcttggatatggaatacataggtctaaaaaaaccatgcatatattttataaatgatgtgtttatgctcttctgtcaacagcatttatgtgcactttgtcaacaggtaaaatgataagaacattgaatacatttttwaaaatttcctaaaaacacaatgaggtaggaagacgtataattattattctttttacagaagaagaaattagatatctgaacagtttgccattttacataattgcaatggtgcaagtttaaaaaaaattaatacatgttctctgactccaaggttgttgttttggataacttacaggttcttgttacatgccaatttattggacaatatatattaaacatatttcctgttacaaatataattctgcagaataattgaaatggctgcataatattccattatatagttgtagcaaaataatt

SEQ ID NO: 7993 - DNA, 601 bp, Human
aaggtgtgaaatgggggaagaatgatagatggaggctaattatttaatattgtaacttctagaaaatagaaaccatgtcctcatttttatcaattagcatgctttaattaatgaattaagaattgtttcaattcccttacctaggaacatactttcaaagaatagtagcatgccaaattctcaccatctggatatttttcaatgaagtcacaatttatctttcctttttattgggaaagcccatctttaatttcctgttttatttttcagagaagttttcatgatacatgctttctttcctttttttttttctttttgacctgtgtgttttttactctatgtaattttggacagctgaatcattacctttcttattcatgtttacagagagtttatttatttggaacaaagagaaagtttaaaaatttggaagttctccaaacattttcagttaagcagcataccatatacagtgattatgattatattttaaaatcctttgtggcttaactaaccatcttatcataagtttgctgctgcaggaaatgtgctgagtgtttaggtaacaagggaacccccaatgtgttcttccagtagtact

SEQ ID NO: 7994 - DNA, 601 bp, Human
gtttgtatcaaagataggaattgatccaaataaatagacaagtttcattacattttgcattatttttatgttgtaagttgaaaaccagtgaaattctttggctaagataacttcctagtaaagactgcaaccagtattgtcaaaatgtatttgaaatgaaaatagaaaattggacttgaatttaattccaatttctccaggcaagcttaaaataaatgtgacagttatgaaaattttgttactatgattatatatttatttctattaaaatactaaaattatagtgcagattgtagtggaragctttagcagttatttacctgatttcattcaatataaacaggcaaaccagatacttttatgggaaacaatttgctctggttatcagccataatcttcatagaatcagcctcaacagatgttctttctaatagaaaaccaatgaggcacagtgttatccctttgtgtagcctgtagagtcacatagctgatcagaacctgcgatgcccctcttaggatacacaaaacttaatagggctggtcattgtgctatagttgcaaaacgaatgcagatactctacactcacagcatacagacaac

SEQ ID NO: 7995 - DNA, 601 bp, Human
agataacttcctagtaaagactgcaaccagtattgtcaaaatgtatttgaaatgaaaatagaaaattggacttgaatttaattccaatttctccaggcaagcttaaaataaatgtgacagttatgaaaattttgttactatgattatatatttatttctattaaaatactaaaattatagtgcagattgtagtggagagctttagcagttatttacctgatttcattcaatataaacaggcaaaccagatacttttatgggaaacaatttgctctggttatcagccataatcttcatagamtcagcctcaacagatgttctttctaatagaaaaccaatgaggcacagtgttatccctttgtgtagcctgtagagtcacatagctgatcagaacctgcgatgcccctcttaggatacacaaaacttaatagggctggtcattgtgctatagttgcaaaacgaatgcagatactctacactcacagcatacagacaacatgtacatcatattttcataaacgatgttgcttatcataatcaatctaatatttattgatcttaccaccatgtatctctgggctaagctagtggtcagaaaact

SEQ ID NO: 7996 - DNA, 601 bp, Human
tcatgcagccccttacagaaaaaacctgctacccctgagctaagcatttgtgataattgtgacaaatatgtcgggagaagggattgagtgtcttgagaatcagaggaagatgacatttgctcaatttgtgtgcaaatatggcttcatgaaatgagtgaacctagtgggtatctgcagagatgagtagtagcattaggcagataataatttagaacaaaaataaaaggacatcccaggtaggaggaagagcagggacagaaactctgagttatgatgggaataatgtgtaaagaacaggaarcatactcacttgtgatgatttagaaaaaataagaaaatggtgggagacagcctggggggaaatatgtctctccctcccacctaacttcttcttgtgtgattgacaggtttcagacagaaaaatccacttctttgcagagctctctatgtcataattgtcttatgaggttaattgttagtaaaatgatgtcatagaaatgccaagttaacgttgcttcatgcccatccattgggtcattgctaaaatgccaagttttatttaactgaatttagcgagattcaagtttttccatgaacaaga

SEQ ID NO: 7997 - DNA, 601 bp, Human
ctagggtgaaacagcaaatattttgaggtcatgtataaagtcctttataaagatgtgaactcttttgccaagatttctttgcagagccctgtattgtataatagttaaccaaaggaagttaaaaggaatgtgaaaaacataagaaaatatggagtatgtagtgcctggtaaagtctctcctactgcttcctttaatttgctggaagtctgggtatggttaatgatactgttgaattatagttgcaatggtgagagagaattgtaaaactcaccctcttgagtgtagcttaatgtaattataaaaaaaaaggtggtagcaaaatccaagtgacataatttatgcttgagtctagatatattctggataactctacatagagaggaaaacccagagggattgcagtttttaggttaggcttcttagtaaataagattttggatgtgttaggaggcctggagtcttgtgaccacacaagggtatgacagggtgagcacagggcgacactattcacccctgctcatctattcatcagtgatactctcctcttcactggcaaggtccctggaaacactattaacaggcatcagtttcttgttcggg

SEQ ID NO: 7998 - DNA, 601 bp, Human
caggaccaatgctgggagatagcccagagagagttaggctgtcctcagatgctccccagaaacccttcatttgcatagtgcttcttttgaagagcccgattttgaaacaccacttctgtcttagctgcaggtgaccccttgtgatccacattggaggtataccccaaccctgccctcaggttagattcctagggctgcaaaaacaaatgaccacatatttgatggctgaaaacaacagaaatttattcccacagctctggagatcagaaatttgaaattgaaaaatgtcaggatccctccmaaggatctaggagagaatccttccttgctgtttctaacttgtggcttttggcgttccttggcttgtgactgcatcactccctgctctgcctctctcttcacatggctatcttacctgcctctctgtgtgtccaagctcccttctcctttctcccataagcacaatagtcttcggacttagggcccaccctaaatccaggatgattcagctctagtctttaattatatctgcaaagaccctatttccaaatgaggtgacaccctggggtcctaggtggacatgaattttgaggaacactat

SEQ ID NO: 7999 - DNA, 601 bp, Human
gcctgaatgtttgtgcccttcttaaaaattacatgttgaaacctagccccaaagttgatgatattagaaggtggggtctttgggaggtgattaggtcatgagggtggagtcctcatgaaagggaatggtgctcttacaaaagagaccccagagtgtggtagtacatgcctgtagtcccagctactcaggaggctaaggtgggaggatttcttgagcccaagagtttgaagctgcagtgagccatgatggcaccactgcaattcagccgggaagacagagaccatgtctctaaaagtaattrtaataataataaaataataaataaataacaaaagagaccccagaaagctagcttgacaattccaccatgtgaggacacagtgagaaggtgccatctatgtgtaggaagcaggctctcgctagacactgcatcttccggtggcttgatcttggacttcccagactccagagctgcaaagcatagatatctgttgtttatgagctactcatctatggtatattttatagcagctcaaatggactaagacaagtatcaaagttcaattagatacagcgtaaaaaagaaagagaaaaacataaa

SEQ ID NO: 8000 - DNA, 601 bp, Human
ttcatgtacttaatcattcactcaatgtgattagttacattggcaatataaggtaactagagaatcttcctagtattcactttagtgaaataatttgggttgctgctatttacctcttacatatgctgcttatagattctggttgaatccacggactttgtttctatgctattaactagctacatggggggaaattatgtttagtgagaatatttgctattatttgttcaacataggcaatagattaggaaagtgttaaagaagacatggttgatgcctactatagatcaaagacttagcracaaaaagctatggtgttgctggtaccagatcacactttgcagcaatctccagtttgggacatataaagagttgttcttcgttttctatgtcctgaaagaattctagcttcctttattacgttttaaaatcctttgtcattagttatagtgctgagcatataagaaaactatacagcatctattttaattaaaagaccttagatgaaagtggcagaatcccaattcaaacaaccagaaacaaataaatgatttatgtgctcacaaaccaaaaaggacaggggtacagatgacctttggga

SEQ ID NO: 8001 - DNA, 601 bp, Human
gtaactagagaatcttcctagtattcactttagtgaaataatttgggttgctgctatttacctcttacatatgctgcttatagattctggttgaatccacggactttgtttctatgctattaactagctacatggggggaaattatgtttagtgagaatatttgctattatttgttcaacataggcaatagattaggaaagtgttaaagaagacatggttgatgcctactatagatcaaagacttagcaacaaaaagctatggtgttgctggtaccagatcacactttgcagcaatctccrgtttgggacatataaagagttgttcttcgttttctatgtcctgaaagaattctagcttcctttattacgttttaaaatcctttgtcattagttatagtgctgagcatataagaaaactatacagcatctattttaattaaaagaccttagatgaaagtggcagaatcccaattcaaacaaccagaaacaaataaatgatttatgtgctcacaaaccaaaaaggacaggggtacagatgacctttgggaagaatggtaaagggacttagacaacctcccacagactctctcactctttcac

SEQ ID NO: 8002 - DNA, 601 bp, Human
aattaaaagaccttagatgaaagtggcagaatcccaattcaaacaaccagaaacaaataaatgatttatgtgctcacaaaccaaaaaggacaggggtacagatgacctttgggaagaatggtaaagggacttagacaacctcccacagactctctcactctttcactttctgtatcacacctacacccgtgtacatacgcatgcacatgggttgacgcaacagcctccaacacacacgtttctgcttttatcagccctttaatctgaatcttgtctactgcagatggatttttctccatasaggaggaacatggattttagcatcgtctaaggttatagttttactatgctctgaccaagaaagattaaaggcttttccttagcagtttaagggagaaaaaaaatattcagggggaaaactcagattgactttgcttggatgaaatggtcaggtttgaaccaatcactgatgatagagggatggtagcgttctaaatttgggtcaccactgggggcaggtgggaattggggcaacgagatgtgagactgtaagactttaaggagtccttctgagcagaccacagttttcactagatacaac

SEQ ID NO: 8003 - DNA, 601 bp, Human
gaatatacatcagaagctgtttctgaattatgtattcccatgtattttgaaaagcttttttacaaaaaatctgaaaaagaattatgtataaaagattatttcctttactgagagtatctcaactataggcataaacatagattagttgagatatgattttcttcttggcttttttcttgctttgtcttaaaatgaaaccagtcctcttataactttttccaaagcacaactttatagcttactcgttgcacctatttgaagtcttacaatttattccatgttgtaatataatcttggtatrttgtttttaatgattacacattaacatattttaaccaagcataatatgcattatattccgtcgtttaatcaatttttctatttaaatggcccatgaacataattacaatattttaatattatggcctaaattgttttactatttttacattgtaattctacattgcaatttgggatgcatgtctttgtctaacatagataagtagattcacattttgcagggtttacattttgggagtcctttttaataaaatgaattcaaaatcaaaagtacaaagttagttaaggtgaatactaactt

SEQ ID NO: 8004 - DNA, 601 bp, Human
aaaccagtcctcttataactttttccaaagcacaactttatagcttactcgttgcacctatttgaagtcttacaatttattccatgttgtaatataatcttggtatattgtttttaatgattacacattaacatattttaaccaagcataatatgcattatattccgtcgtttaatcaatttttctatttaaatggcccatgaacataattacaatattttaatattatggcctaaattgttttactatttttacattgtaattctacattgcaatttgggatgcatgtctttgtctaacrtagataagtagattcacattttgcagggtttacattttgggagtcctttttaataaaatgaattcaaaatcaaaagtacaaagttagttaaggtgaatactaacttaggatgaaaaggcaatcagcacaaattacatttttatatcagacagataccataaacctcacaaatctagaatatgatgtaattataattttacacatctgttgtaagtggctctgtatatttcaaaacttgttcattctcaacttcttaaatgtgggctgagcattataggatgcatacaattttattatttg

SEQ ID NO: 8005 - DNA, 601 bp, Human
ttcctggagatattcttagatgtttactaggttgctttggagagtgagaagaaatctgggcttgttgagctttacctaccctacctactgctttctctgggcaaattcacttacatatgttttatttagcatggatctgttaatactttcatttggaatgaaatgtttctgccggtttctttctgttcttgtgcaaatgtgaaaactattgctttagcgaaagcaaacaccgttacttcctgaatcacagctccctccaaaccactcctctccagataaacatttatgttttatgccccartaactacacttccttttattttccctgctctgagccttgaagtgttcacctgaaagcattttaaaatagtctgtaattccaaaggaaatgaagtaattgtccatggaagggaggtgaggactcaggatacagattgacctggggttgctcatgaattgagaccaaaagaaaaacagaggtagaataaaatgaaagggagaagagctcagtgaacatctgtgctttctctttgccgagtcctgacacagcgctcactacccctctgcattttatccctgtcaccatttggagaatcaggca

SEQ ID NO: 8006 - DNA, 601 bp, Human
aatctgggcttgttgagctttacctaccctacctactgctttctctgggcaaattcacttacatatgttttatttagcatggatctgttaatactttcatttggaatgaaatgtttctgccggtttctttctgttcttgtgcaaatgtgaaaactattgctttagcgaaagcaaacaccgttacttcctgaatcacagctccctccaaaccactcctctccagataaacatttatgttttatgccccaataactacacttccttttattttccctgctctgagccttgaagtgttcacctraaagcattttaaaatagtctgtaattccaaaggaaatgaagtaattgtccatggaagggaggtgaggactcaggatacagattgacctggggttgctcatgaattgagaccaaaagaaaaacagaggtagaataaaatgaaagggagaagagctcagtgaacatctgtgctttctctttgccgagtcctgacacagcgctcactacccctctgcattttatccctgtcaccatttggagaatcaggcaggaaggcccagcatcagggatttcctctcccttcaaattctggtccctgcaa

SEQ ID NO: 8007 - DNA, 601 bp, Human
aactattgctttagcgaaagcaaacaccgttacttcctgaatcacagctccctccaaaccactcctctccagataaacatttatgttttatgccccaataactacacttccttttattttccctgctctgagccttgaagtgttcacctgaaagcattttaaaatagtctgtaattccaaaggaaatgaagtaattgtccatggaagggaggtgaggactcaggatacagattgacctggggttgctcatgaattgagaccaaaagaaaaacagaggtagaataaaatgaaagggagaagwgctcagtgaacatctgtgctttctctttgccgagtcctgacacagcgctcactacccctctgcattttatccctgtcaccatttggagaatcaggcaggaaggcccagcatcagggatttcctctcccttcaaattctggtccctgcaaccagctggagccacccacagattccctttgttgatgagtgcttccggaaggtgaaggagaacctccccatcagggggctgcaatgttccaaactgcagcatcattcatgacgtggctaacatttaccttcatttttgtagggggtggagaa

SEQ ID NO: 8008 - DNA, 601 bp, Human
tttcagttcctttgggtaaataacaaggagtgtgattgctggatcatatagtatgtttagttcagtaagaaactgctgaactgtcttccaaagaggctgtagcattttgcattcccaccagcaatgaatgaaagtctgtgttttctccacatccttgccagtgttgggtgttttcagtgttctggatttgagccattctaacaagcgtatagtggtatttcatcgttttaatttgcatttgcctgatgacaatatataatatgaaacatctttttatgtacttgtttgccatctgtatgtyttctttaataaggcatctgttaagatctttgggccatttttaaattgtttttctcttattgttgagttttaggagttatttgtatattttaagtaacagaactttatcagatatgtcttttgcaaatattttctccttgtctatgacttatctttttgttctcttgatatttcttttcttttctttttctttttctttttttttttttaagacaaagtctcgctctgtcacccaggctggagtgcagtggcatgatctcagctcactgcaacctctgcctcctgggttcaagcaattctc

SEQ ID NO: 8009 - DNA, 601 bp, Human
attgttgagttttaggagttatttgtatattttaagtaacagaactttatcagatatgtcttttgcaaatattttctccttgtctatgacttatctttttgttctcttgatatttcttttcttttctttttctttttctttttttttttttaagacaaagtctcgctctgtcacccaggctggagtgcagtggcatgatctcagctcactgcaacctctgcctcctgggttcaagcaattctcctgcctcagcctcccgagtagctgggactacaggcgtgcaccaccatacccagctaattttttttttttttgtatttttagtagagactgtgtttcaccatgttgtccaggatggtcttgatctcttgacctcgtgatccacccaccttggcctcccaaagtgctgggattacaggcgtgagccaccacacccagccctctcttgatatttcaatgctttttacatgatctagtatatgatggatatctctatttttcataaatgttctgtggatagtttagagaaggttgattagagtaagaggcaaagttgacatattaaataaattatccttattaattattttgttctgagtta

SEQ ID NO: 8010 - DNA, 601 bp, Human
agaggcaaagttgacatattaaataaattatccttattaattattttgttctgagttatataatactgcttagactttctcataatagtaatcaacttctcatctgtttctaacagtttttatgtcatatatattgataatgagtgatattgaccaaaaattcatgacttcacatattccttaacattcaaattatagaaaaagaaaatcatatgacctttttgttttgtttagttgttttgtgttaaattctgctgagtctgaaatttaggctaccatgccgtttttctatatgcttgakaaatctttgacaaccctttacattttattcttcttcattcctttgagtcagatttgtcactttggggcagcatacactttgatttatgattttgttaattttttacctaatctacaaatctttgctgtaagagagtagggattaaaatatttgagtttactatcataattgacatatttgattttattcctgccaacttattttatcctttcttcataccatttttaattttgtgtcttctttcaattattttataaaatacactgcatacagtttaatgcccaatcctttgaaaataaa

SEQ ID NO: 8011 - DNA, 601 bp, Human
gatttgtcactttggggcagcatacactttgatttatgattttgttaattttttacctaatctacaaatctttgctgtaagagagtagggattaaaatatttgagtttactatcataattgacatatttgattttattcctgccaacttattttatcctttcttcataccatttttaattttgtgtcttctttcaattattttataaaatacactgcatacagtttaatgcccaatcctttgaaaataaatatatatttttatttatcctaatggttaccttatattattttaaaaacatygtcagtattcattttatatcaaggtctcaaatttaatggtgtcatttgttcttcatctatttaaaatgaaagatatagcattttttcaattttcctcccatctttactcactggaaattattagtataaactttgctttttataactaggtaaataaaattttaactattttatagtgcttctgttttaatcattaattttgatatttccattgagttgtataaccgtatttatagtggtccttaaatccgactactataggaattgattaacgtaatatagacagccccattttccaat

SEQ ID NO: 8012 - DNA, 601 bp, Human
ctaaaataattttgaagcatgtgttctgaattcgacttgtcgctttgctggttctgtagctctatcttatgctccaactgatcagacatatgttgatcactctgtcctcttcttggagatgttcagcacttgttggttagttaaagactctgatatatcctgcagtaagaaaagtctttaactctgtccaaccaatatttcctgaaattaattgatcctggaacttttctccccatgaaacaccttacagagctactgtttcatgaaatcatatttgatcgcaaatggttaaaaatatgtygtcttatagttagtaaatatcttggggaattctttcactgctatgattatacactaatattcatcttcaccttaaggataatttatttgattttctatttaattgcagtttctttacaaatgaaaagaaattgtgatgcagtttcccagtgatttttttttttgcaatgtaaaaatgatttgtagatgttaagtctatatctcatagttctttaaatgaggaggaaaggcatttaatgagtttgtatagacacattttcagatacccacacagagaaactgcagaagagaagtgcaaaca

SEQ ID NO: 8013 - DNA, 601 bp, Human
acgagattaagtttagggatatgcaaagtaagatacttttccagtgagatgggaaagatttcaataaagatgttatataaagaaagttttgagaatccactgggctagtcatttgggactagctttcttaaacatttcattcatttattccttaattacgtttttacagtggacctactcagctaagagtgccaggtgtgtgtcatatgcactgaataggaaattatcctgttctcacagatgtcttacatttcagtgggggatataaacaagaaacaaaggaattcctttttaaaatcakaagtgcaatgaagaaaatgataaaagaagagtgtggctatttgcaaggggcagggatagtatttgcaagaggaaggggtgaatgaaaagggagctgataaggaaccaatgttttatctaagacccgaatgaactaaagaagcatagatatactttcaatataagcaaaaggtgtgtgtgtgtgtgtgtgtgtgtgtgtgtatttctagttttataggcaattatgctcaatttcaattcgaatttcctttttttttagctttatgtgcatatcttaactgtagcagctatgctgggaaca

SEQ ID NO: 8014 - DNA, 601 bp, Human
ttgcaagaggaaggggtgaatgaaaagggagctgataaggaaccaatgttttatctaagacccgaatgaactaaagaagcatagatatactttcaatataagcaaaaggtgtgtgtgtgtgtgtgtgtgtgtgtgtgtatttctagttttataggcaattatgctcaatttcaattcgaatttcctttttttttagctttatgtgcatatcttaactgtagcagctatgctgggaacatgttaaattgtatattatatagtcaaaagaaaatgagaatgtacaattatctgggaaggtttygtatcattcatacagacttttagaaaaaaaaattggttccctaaattatctgtgttgcctcagcaaataagagtctctcaagcttttgtggcacaaaatatcctatggagcaaaagatttagtcactgagttatttccacccctggcctaccttcaaaaaagaatgtcataccgaaggaaataaaacacatgttaaatatctgcataataaacgaaataaaagaaccgaaaataacatctatttcaatagaatgaataagaatataatctctttgaaataaactccaatttagtcataaa

SEQ ID NO: 8015 - DNA, 601 bp, Human
caagtatggtttgaagttaaatcggtgctggggacaacaaagtcaaaatgattggaacagtattttttttttttttttttttgagacagagtctcactctgtcacccaggctagagtgcagtggtgcgatctgggctcactgcaaccaccgcctcctgggttcaagccattctcctgcctcagcctcccgagtagctgggactacaggcacgtgccaccacacctggctgaatttttgtatttttagtagagatggggtttcattgtgttagtcagaaaggtctcgatctcctgatctccygattcacccgccttggcctcccaaagtgctgggattacaggcgtgagccaccatgcaccatggaacaataattttaagaacattaattgttgacatcttggctgccatcacaccaacagaaatactaccatcactctaagccaactctctcttttacctttggtttacatgggcataccatatctggctacagagaaattctccaggagtctgcagtacactttcacattgtccagcaatgctaacattcaatcttagaggtcatttagcagctcatgactgagttgattttgtgcagta

SEQ ID NO: 8016 - DNA, 601 bp, Human
ccatatctggctacagagaaattctccaggagtctgcagtacactttcacattgtccagcaatgctaacattcaatcttagaggtcatttagcagctcatgactgagttgattttgtgcagtaaggcatagatctataatgaaaaacaaatcttcatttacttctgttgccccatttaatgattatgaagagtaaactcttataaagtaaagtaatactctacttgaaaggaatattcctgttacactataaaatatattaccagatattaatttgatggtagaacaaaggaaggatctgytataaaatatatcaagtaaggttttacatgtcattatacacaactgcagagttttttgagaggctctaatgaaagggtacttctcatgctttggaagctcaagtcttcctcctcaaagagagtcaatgacattattttacagaggattttgtagaaatgaaaggtaattaatgccatataaaagcaaaaacattacatctgtaattgctacatagcatgtgcatgacaagttgctggtgcccataagggacagcacttgaaggtcaaaggaaagagcatacccttccacctctcagtttg

SEQ ID NO: 8017 - DNA, 601 bp, Human
tttcacattgtccagcaatgctaacattcaatcttagaggtcatttagcagctcatgactgagttgattttgtgcagtaaggcatagatctataatgaaaaacaaatcttcatttacttctgttgccccatttaatgattatgaagagtaaactcttataaagtaaagtaatactctacttgaaaggaatattcctgttacactataaaatatattaccagatattaatttgatggtagaacaaaggaaggatctgctataaaatatatcaagtaaggttttacatgtcattatacacaaytgcagagttttttgagaggctctaatgaaagggtacttctcatgctttggaagctcaagtcttcctcctcaaagagagtcaatgacattattttacagaggattttgtagaaatgaaaggtaattaatgccatataaaagcaaaaacattacatctgtaattgctacatagcatgtgcatgacaagttgctggtgcccataagggacagcacttgaaggtcaaaggaaagagcatacccttccacctctcagtttgatttgagtattaaatgagctagcacacagcttggcacatgttag

SEQ ID NO: 8018 - DNA, 601 bp, Human
ggaaagagcatacccttccacctctcagtttgatttgagtattaaatgagctagcacacagcttggcacatgttaggctttcagtatttaccttctttcttaaaaaataaaaaaaaaaaactatttgtattagcccgttttcatgctgctgataaggatatacctgcaactgggcaatgtacaaaagaaagaggtttaatggagtcacagttccacatggctggagaggcctcacaatcatggtggaaggtgaaaggcacatctcacatggcgggagacaagagagaatgagaatcaagcraaagggatttccctttataaaaccatcagatctcataagatttattcactaccatgagagcaatatgggggaaaccacccccatgattcaattatctcccactgggtccctcccacaacacatgggaattatgggagctacaattcaagatgagatttgggtgggaacacagccaaaccatatcactattattcagagtaattatgatcaaatgcaacagtgagattgaaaatattatttaatattgcattttgagtacaaataaattttggcttttaatcgtgaacagtcataatgttg

SEQ ID NO: 8019 - DNA, 601 bp, Human
gaataatttttgactcaataacagacacaccccctcccaatcaaatggcagtttaaacaaattttgagggaggtcttattttgaggaagtgtaaaggtaggcaggttagggctggtgtgaccactgtgtaacatgaccaagtctctcatcagagaccaaggcttgctttggcttgtggtctgtaagatggaaccacacttgcactcatgctctaagatatctgcagggaccctagagtcatccctgcgtctcaggaaggaagaaagtaaaatgccaagggaaaacaaaacgacattgcttrttctttaagtaaagaacttgacacctttaaagccaccttttcaggagcccactcagtggcttctgtttctttttcatacaattatatttcattgactttgattgcattcgacaggatatagctatgcctatctgtgaatgagcctgggaatagagcttcgtatttgggcacattataaacctgaaaaaaaaaatttgtctctaagaaacaagggggtcattatattgtataggcaactagcattctcattgctttttctctcattcggggaaattaagtataatcaataccttgaggcat

SEQ ID NO: 8020 - DNA, 601 bp, Human
agatggaaccacacttgcactcatgctctaagatatctgcagggaccctagagtcatccctgcgtctcaggaaggaagaaagtaaaatgccaagggaaaacaaaacgacattgcttgttctttaagtaaagaacttgacacctttaaagccaccttttcaggagcccactcagtggcttctgtttctttttcatacaattatatttcattgactttgattgcattcgacaggatatagctatgcctatctgtgaatgagcctgggaatagagcttcgtatttgggcacattataaacctgaaaaaaaaaatttgtctctaagaaacaagggggtcattatattgtataggcaactagcattctcattgctttttctctcattcggggaaattaagtataatcaataccttgaggcatagtttgcaggttctatgcaaaagccttctctggggtgagccaggtaagcagccagggagtgagacagggaatctgaatacgggctctaagaagtgaagatgaaaagctcagggatgggcatagcatgaggttcatgccccgcaactgcctcacgcaggagggacacgtgggtaaggagactgag

SEQ ID NO: 8021 - DNA, 601 bp, Human
tgacgttttcatcatgaaatttttgcccgggtctatgtcctaaatggtattacctagattttcttctagggtttttatagttttgggttttacattgaagtctttaatccatcctgagttaatttttatataagatgtaaggaaggggtccagtttccattttctgcgtatggctagccaattctcccagcaccactcattaagtaaggagttctttccccattgcttgttttcgtcaggtttgttgaagatcagatggttatagatgtgcagtcttatttctgagttctctattctgttscattggtctatgtgtctgttttgtaccagtaccatgctgttttggttaccatgtgactttttaaaaaaaattatttatttatttatttatttttagagacaggatctcactctgtagttcaggctacactttatcttagccaaaagaccaagaagtcatgtcgcccaggctagagtgcagtggtgcattcatggctcactgcagcctcaaactcatggactcaagagatcctcctgcctcagcctccagaggatctgggcctgcaggtgcatgccaccacacctagttaattttttttac

SEQ ID NO: 8022 - DNA, 601 bp, Human
ctgcgtatggctagccaattctcccagcaccactcattaagtaaggagttctttccccattgcttgttttcgtcaggtttgttgaagatcagatggttatagatgtgcagtcttatttctgagttctctattctgttgcattggtctatgtgtctgttttgtaccagtaccatgctgttttggttaccatgtgactttttaaaaaaaattatttatttatttatttatttttagagacaggatctcactctgtagttcaggctacactttatcttagccaaaagaccaagaagtcatgtcrcccaggctagagtgcagtggtgcattcatggctcactgcagcctcaaactcatggactcaagagatcctcctgcctcagcctccagaggatctgggcctgcaggtgcatgccaccacacctagttaattttttttacattttttcagcaacagggtggccatgtgaccttatgtaagttacctaaaccctgtaagtctatgtgcctcatctgaaaaactgataaaaacagaaccctctttatagggtcatggtggagaagaatcaaacagtggacaaggaatatttagtataatgccagg

SEQ ID NO: 8023 - DNA, 601 bp, Human
gtttgttgaagatcagatggttatagatgtgcagtcttatttctgagttctctattctgttgcattggtctatgtgtctgttttgtaccagtaccatgctgttttggttaccatgtgactttttaaaaaaaattatttatttatttatttatttttagagacaggatctcactctgtagttcaggctacactttatcttagccaaaagaccaagaagtcatgtcgcccaggctagagtgcagtggtgcattcatggctcactgcagcctcaaactcatggactcaagagatcctcctgcckcagcctccagaggatctgggcctgcaggtgcatgccaccacacctagttaattttttttacattttttcagcaacagggtggccatgtgaccttatgtaagttacctaaaccctgtaagtctatgtgcctcatctgaaaaactgataaaaacagaaccctctttatagggtcatggtggagaagaatcaaacagtggacaaggaatatttagtataatgccaggaaactagttgactggtcatagtcacacagatgcttcagggcaggcctatttcttgcatacctgtgatttcaggaca

SEQ ID NO: 8024 - DNA, 601 bp, Human
tattctgttgcattggtctatgtgtctgttttgtaccagtaccatgctgttttggttaccatgtgactttttaaaaaaaattatttatttatttatttatttttagagacaggatctcactctgtagttcaggctacactttatcttagccaaaagaccaagaagtcatgtcgcccaggctagagtgcagtggtgcattcatggctcactgcagcctcaaactcatggactcaagagatcctcctgcctcagcctccagaggatctgggcctgcaggtgcatgccaccacacctagttaattttttttacattttttcagcaacagggtggccatgtgaccttatgtaagttacctaaaccctgtaagtctatgtgcctcatctgaaaaactgataaaaacagaaccctctttatagggtcatggtggagaagaatcaaacagtggacaaggaatatttagtataatgccaggaaactagttgactggtcatagtcacacagatgcttcagggcaggcctatttcttgcatacctgtgatttcaggacattttcagaagtcccagacctagaacccataggtggagaatccaaattttttg

SEQ ID NO: 8025 - DNA, 601 bp, Human
acttttctttcctttgagagatcactgtggctgctatgtggtggatgcctccagggacccgaaggtggggacaaaggccaactaagaaacacaacaggagttcaggtagaagatgatggtggcttagactgggagcggtggaaatggtatcataatttccatttgacatccattttaccaaaggtttgagatttggaatatgagtgaaagggaggaatcaaggtcatttttggtctgagttactgtctgaagagtcatgccattaacagagaaacagaaggcattgaggagctgactcgayggtggcatgggcaaatcagtggttctccttcggtcatgttacatttgaggtgcttatgatataaagtgagaagttcaatacagacgtctgaaagtaaaaagagaagtctgtgttagacatgtagatgtcatgtcttcagaatgcagatcggtgtaaagctctgggcctggatgcaaccacccagggagaaagtctacttatgggaaaggctggggacaaagcaacatttccaggtctgggaggagagacctggaaaccaagaagaaagggtcaaagcagtgctgaggaacaggcagattt

SEQ ID NO: 8026 - DNA, 601 bp, Human
aagaaacacaacaggagttcaggtagaagatgatggtggcttagactgggagcggtggaaatggtatcataatttccatttgacatccattttaccaaaggtttgagatttggaatatgagtgaaagggaggaatcaaggtcatttttggtctgagttactgtctgaagagtcatgccattaacagagaaacagaaggcattgaggagctgactcgacggtggcatgggcaaatcagtggttctccttcggtcatgttacatttgaggtgcttatgatataaagtgagaagttcaatacasacgtctgaaagtaaaaagagaagtctgtgttagacatgtagatgtcatgtcttcagaatgcagatcggtgtaaagctctgggcctggatgcaaccacccagggagaaagtctacttatgggaaaggctggggacaaagcaacatttccaggtctgggaggagagacctggaaaccaagaagaaagggtcaaagcagtgctgaggaacaggcagatttcagttagagcaaaaagataaaagcaatgttcagagaagaaggtgtatgggtatagatgaccttggtgatgacagattaaattt

SEQ ID NO: 8027 - DNA, 601 bp, Human
aagagaagtctgtgttagacatgtagatgtcatgtcttcagaatgcagatcggtgtaaagctctgggcctggatgcaaccacccagggagaaagtctacttatgggaaaggctggggacaaagcaacatttccaggtctgggaggagagacctggaaaccaagaagaaagggtcaaagcagtgctgaggaacaggcagatttcagttagagcaaaaagataaaagcaatgttcagagaagaaggtgtatgggtatagatgaccttggtgatgacagattaaatttcacagacattaggaarggagtgcagaggagaaggggccacgaggaatagatcagaatagtgacgcatttccttttggtggcgtgcaatctggagacagatttctgaagatgactgaggtgaaagtgatgcaaggaatgatgcacttgcttaaaagcaaagtgtgccatgaaggcggggatcttggcaaagaggagaattaattcatcaaagcaccctgcccttgaaatctcaccacactgctagattgaaactagattgatggcacagaatgggtgttttgttttatcttatctctctattttcttatgtgggagg

SEQ ID NO: 8028 - DNA, 601 bp, Human
tgaccttggtgatgacagattaaatttcacagacattaggaaaggagtgcagaggagaaggggccacgaggaatagatcagaatagtgacgcatttccttttggtggcgtgcaatctggagacagatttctgaagatgactgaggtgaaagtgatgcaaggaatgatgcacttgcttaaaagcaaagtgtgccatgaaggcggggatcttggcaaagaggagaattaattcatcaaagcaccctgcccttgaaatctcaccacactgctagattgaaactagattgatggcacagaatggrtgttttgttttatcttatctctctattttcttatgtgggaggagtggacatattgcaaaaagcagttgccagacatgcacatttaaatgtactgaaacgcaaggtgatagacaagaaaaatttagtcaaatttatgcattaataatttatcttcagaaaatgcaaatccctgttgtagttattttcctatttctacaaatgtaattaaagcattgataacacaggggaaccacagcatcggaattgagaacaacctggtgtgaaagaaaagaagtgttgaaaattttaagtttccctctc

SEQ ID NO: 8029 - DNA, 601 bp, Human
aagcaccctgcccttgaaatctcaccacactgctagattgaaactagattgatggcacagaatgggtgttttgttttatcttatctctctattttcttatgtgggaggagtggacatattgcaaaaagcagttgccagacatgcacatttaaatgtactgaaacgcaaggtgatagacaagaaaaatttagtcaaatttatgcattaataatttatcttcagaaaatgcaaatccctgttgtagttattttcctatttctacaaatgtaattaaagcattgataacacaggggaaccacarcatcggaattgagaacaacctggtgtgaaagaaaagaagtgttgaaaattttaagtttccctctcctatgctttctattatttctgtgtgtaaacccaattttcacttcccctttctatgaagctaatgctagatcttatctcttgacatttaaaacatccactcttcctgccaacattcatttgcttctccattgttaaatcggatagtcacaactctgatgtgctgtgttgtagtacctgagctgatcgtatggaggcagatcttatgacgctggccattgccacaagtgataattgg

SEQ ID NO: 8030 - DNA, 601 bp, Human
accctgcccttgaaatctcaccacactgctagattgaaactagattgatggcacagaatgggtgttttgttttatcttatctctctattttcttatgtgggaggagtggacatattgcaaaaagcagttgccagacatgcacatttaaatgtactgaaacgcaaggtgatagacaagaaaaatttagtcaaatttatgcattaataatttatcttcagaaaatgcaaatccctgttgtagttattttcctatttctacaaatgtaattaaagcattgataacacaggggaaccacagcatyggaattgagaacaacctggtgtgaaagaaaagaagtgttgaaaattttaagtttccctctcctatgctttctattatttctgtgtgtaaacccaattttcacttcccctttctatgaagctaatgctagatcttatctcttgacatttaaaacatccactcttcctgccaacattcatttgcttctccattgttaaatcggatagtcacaactctgatgtgctgtgttgtagtacctgagctgatcgtatggaggcagatcttatgacgctggccattgccacaagtgataattggcaat

SEQ ID NO: 8031 - DNA, 601 bp, Human
accctttcaaaatccactcatattgtaatttgtttgtaataggtgacaatatttttctttcatttatagataactaatcttcacctttatcaaacatgtctttcaagagtatgtaatacatcgattgcagctccaagtctacatcatctgtttttgcatccttcttatttacttatttttctttttgtcaataaaatacatcttaaatatatagtcaggctcctctttagctcaaatagtgttgttttgtttaattagactgtgttcccagtattgcttctatttttttttctttttttctttttttttttaattatactttaagttttagggtacatgtgcacattgtgcaggttagttacatatgtatacatgtgccatgctggtgcgctgcacccactaactcgtcagtattgcttctatagaaggctagcccaaatgcagagaggaaaatggcttgacttggccttaaatataatgaagcttgtacagtgtgcattgtgttttaagtttgaatatgaatgtaactgctacatgtattgtattaaattaatgaacttttattatgcttagcccagtgtatcctcagtttttaattcaa

SEQ ID NO: 8032 - DNA, 601 bp, Human
ggaaaatggcttgacttggccttaaatataatgaagcttgtacagtgtgcattgtgttttaagtttgaatatgaatgtaactgctacatgtattgtattaaattaatgaacttttattatgcttagcccagtgtatcctcagtttttaattcaagttgcacaaaaatttattattttgcttcttgataaaatgatttattaatattttattcaacctcattgttttaagcttttctgaaacatattccctctttaatcaatgatgatatgctagctttaggtaaacggtctgatgttaacmcatatacagagagtataaaattccacttgactcctcaagtgcccatcaaacattttttttaaaactcttttgatacatcttagtcccattctgcattttatatgggtcccattctttgattttcatttgttttattacatttgagtctctttacaaattagctaaatatgcccaaactctaatggtgttgttgtagattttttaaagttacaaaatattttgagattggttttctacttgttgaaactggacttcatattgcagggtaatattcccccatggggccatcagtattcataa

SEQ ID NO: 8033 - DNA, 601 bp, Human
ttaaatcagttaaattataatctaaaataaaaggtgattttagtgcatatacatgcatgtgtatgcatgtatatgcatatgtgtcttatatacttatattaaaattttgaactggcaattagggaagtggttttttaaactgggataatacattttaaaaatatgtagtggatgggaatctcaggtaatggcataaaagtgctaatgacctgcacaagcattgaatgaaagatgcaaatgagcagcttaatggaaaaaatatgaggaacttggtgctaaatcattcacagtcaacctgttyctgggctggggtttcctaagcagcggagcacctccctcactaccgtctattgaaagtcagcttttaaacaataatagtaataaataataaaaaataataaaaatatacatatatcaaactttgacaccatggtgtacattttagataaatcaatatttgttagactacagcactaacaagtttctatcttaaacattatagtgacccctaatcaggccttagagtggtgattgaattttttttttttttttttttttttgaggcggaatctcgctctgttgcccaggctggagagctgga

SEQ ID NO: 8034 - DNA, 601 bp, Human
caattagggaagtggttttttaaactgggataatacattttaaaaatatgtagtggatgggaatctcaggtaatggcataaaagtgctaatgacctgcacaagcattgaatgaaagatgcaaatgagcagcttaatggaaaaaatatgaggaacttggtgctaaatcattcacagtcaacctgtttctgggctggggtttcctaagcagcggagcacctccctcactaccgtctattgaaagtcagcttttaaacaataatagtaataaataataaaaaataataaaaatatacatatataaaactttgacaccatggtgtacattttagataaatcaatatttgttagactacagcactaacaagtttctatcttaaacattatagtgacccctaatcaggccttagagtggtgattgaattttttttttttttttttttttttgaggcggaatctcgctctgttgcccaggctggagagctggagtgcagtggggcgatctcagctcctcagctcactgcaacctctgcctcccatgttcaagggattcccctgcctcagcctccagagtctacttaaaacacataaatagaaggcaga

SEQ ID NO: 8035 - DNA, 601 bp, Human
caagtatatttggtaccagccgaagtatacatttgaattattcctgctgacagaatttcaaatgtagattaatttactttaagcttgattaattggccattctttcctgtagctgggactacaggcatgtgccaccgcacctggctaattttttgtattttgagtagaggtggggtttcaccgtgttagccaagatggtcttgatctcctgacctcgtgatccacccacctcagcctcccaaagtgctgggattacaggtgtgagccaccgcacaggtcctggtgaggtaatttttaagtractatgtatctgttcatatgtaagtatatgtgtgtaggagtgcagatgccagtgtgtttggacctctggggaaggagagggtaagcaagagatatgatgcaactcagcctcagatgagctcaatcactcacagaattaattaaggtaattgaccctcattcacttctgggttcctcaataacagcactactaacattttggaccaaataattatttgctgtggagactgttcttctgtgcattgtagggtgtttaggagcctccttgacctccaccctatagatgccagtagcactgtaa

SEQ ID NO: 8036 - DNA, 601 bp, Human
ctgtgcattgtagggtgtttaggagcctccttgacctccaccctatagatgccagtagcactgtaaccaccagacaggttcttcctgcccgctgaacaaagttaattcatggagaccatagcattgcagtaaagaaatagtttaataaagttgaggccggccacaccacgtgggagacagttgtaactcaaatcaattttcttgaaggctcagaggttaggggttttttcaaagatagtttggtggataggggcccagggagtggggagtgctgattggttgggtcagagatgaaatcatrgggagttgaagctgttctcttgctctaagccagttcctgggtgggagccacaggactcaggactggttggcaaatgctggtggggccatccagttttcagaaatgcaaaatcctgaaaagacatctcaaaaggctagtctcaggttctacaatagcaatgatatctgcaggagaaattggagaagttgcaaatcttacgacctctggaataatgggtgttaattatgtaactatgtttgcatcttagcagaattcaggtccctctcatcttcctaacctggtggccttttattagtttta

SEQ ID NO: 8037 - DNA, 601 bp, Human
ggaatttacccacagagctcctttcatgtgagcttatggtttattcctcttgcttcagcttatagctcttgttttcgggtttcctgaaggatattacttcctataagtccagtaataaaacaaacaattgatatttggtataatagattatttggtctttgcattgctggaagctaaagcccatatactgtgtgcttcattgtaatatatctttcatcatgctatttcagaatgtgacaattactaaaagctgacatttgagatcatatcaccacctaatattttttttcaaaagtaaaartaaagtggaagataaacgagaaacttagaaaagactaggtttagaaagtttattaattatacttctgaaaaagcaattgtcattttctaaacggataaaaatgaactgcaaattaaaattcccagtggaattaatgcagtgactcattacataatacatcatgggcaagtaatccatcctttgtactctcaggcaatcggatgtatttaagccaaagataattcaagacaaaagtaatcagggttcctccaacatcgctttttatgtgacatagagcttatcattgtttaaagcatcgaa

SEQ ID NO: 8038 - DNA, 601 bp, Human
aaaacaaacaattgatatttggtataatagattatttggtctttgcattgctggaagctaaagcccatatactgtgtgcttcattgtaatatatctttcatcatgctatttcagaatgtgacaattactaaaagctgacatttgagatcatatcaccacctaatattttttttcaaaagtaaaagtaaagtggaagataaacgagaaacttagaaaagactaggtttagaaagtttattaattatacttctgaaaaagcaattgtcattttctaaacggataaaaatgaactgcaaattaraattcccagtggaattaatgcagtgactcattacataatacatcatgggcaagtaatccatcctttgtactctcaggcaatcggatgtatttaagccaaagataattcaagacaaaagtaatcagggttcctccaacatcgctttttatgtgacatagagcttatcattgtttaaagcatcgaactgcttaggcattctttgttctcttttattgccttcatttcattgtctgaatagcttttgtagtatgatgttaactatcactgtttggactgattgaatagtttatttattttgat

SEQ ID NO: 8039 - DNA, 601 bp, Human
agtttaatttcaatttcaagcaaatactatttattctacattttctatagtcagggagacatgagggcttgcatgaaggacctgcatgtcaaattcctctattttctgacttttttccattaccaatatagacataatcacatacatttggttgttcttacttttccaacagcctccctccctttctctttactgtaattggaagcatatttccatctcttcctctgtctccatccctcccactttgatattcttattaaagtggaatatttcctcttatctggtagaatgtgaggaaaayagggcaccctaatttatttgatcaccgttcagtttttctcggtaactaagtttgtccctgaaagtttctggtctcacttatggttacattgttaattatcttggaatagtgaaaaagatagtcaatatttttttttcatatgtcttcccacagtgtctgaactatttccatgattttttgactattcgcttttgtctttgtagaaaatattcattaggatataatttacaaatctaattttcatagttctggatcacttattgccccagtaaattccattatttggaactgtacctctat

SEQ ID NO: 8040 - DNA, 601 bp, Human
aaaacaggactggtagttacaactggtgtagctttatgaatctctaattctattacatctgagacactttagagatcgcttgatctagtctctttgtgcagaaaacaaggaactgaatctttgagaagcaaaagtggcttatccaggctacataattaaaactgtcatcaaaatgggcctcccagctgccatcacagtgcttggcccataccaaccattgattcttactttcctatcaggcctgggcatattccagtctgtccaccatttcttgtgcatatccttacaataaacatgaaayttatattttataatccaaattgaggtaatgttccatttgactgtcatacaaggtttcccaatcaaaagcagatgagatagtggttgaggccaaggcatcctgggtattagttatgtatttaaattctctaattaattgtctccaggaaggaaacaaatgtgtacactttggaatttgtctgtattactactaatgtaaaataaacattgcactaaaacttggatgatgattgaaaaaacaatttaaaaaccatgaaagaacaccacaaaatatttttcttacttgaactacattaatgtt

SEQ ID NO: 8041 - DNA, 601 bp, Human
ctggtgtagctttatgaatctctaattctattacatctgagacactttagagatcgcttgatctagtctctttgtgcagaaaacaaggaactgaatctttgagaagcaaaagtggcttatccaggctacataattaaaactgtcatcaaaatgggcctcccagctgccatcacagtgcttggcccataccaaccattgattcttactttcctatcaggcctgggcatattccagtctgtccaccatttcttgtgcatatccttacaataaacatgaaatttatattttataatccaaattsaggtaatgttccatttgactgtcatacaaggtttcccaatcaaaagcagatgagatagtggttgaggccaaggcatcctgggtattagttatgtatttaaattctctaattaattgtctccaggaaggaaacaaatgtgtacactttggaatttgtctgtattactactaatgtaaaataaacattgcactaaaacttggatgatgattgaaaaaacaatttaaaaaccatgaaagaacaccacaaaatatttttcttacttgaactacattaatgttcaaggtggcctaagggaaagag

SEQ ID NO: 8042 - DNA, 601 bp, Human
ctgaaaataagtggactggactaacttcgcagttttatgtgctacatttgtaactggattccagaaaaaattattaggagaaggagaatttagagcttaacattctgttcacctaatataaagttacagagtgtcagatcagatagcatcatccaattagtcaatttacattgacataatatatatgggacttccataatgaacaatagtcaaaatgtattattttgggaaatcttgaatcaaattatttacaggtatcctgagagatctctattataataattgtaaaaggcagcaatarctttctgaaaaatatttatatattgtttcttttttaaatattgtttaattatacttattttttatttatgtctataatgtaaggtaagggttaaaaatactgtttaaatgcagttgggatatataattgatccaggatcaatttattgaaaaataaacttttttcactgcactgtaacattagcccaccataaatcaagtgaccttatgtgtatgaacctgtttgtggtgtttctattctgtttcatttgcctatttgtctgatcttgtactagcaatccattcttgtttgtttggttgg

SEQ ID NO: 8043 - DNA, 601 bp, Human
gaccttatgtgtatgaacctgtttgtggtgtttctattctgtttcatttgcctatttgtctgatcttgtactagcaatccattcttgtttgtttggttggtttttgtgagatgaaatctcactctgttgcccaggctggagtgcaatggcatcatctcagctcactgcaacctctgctttccaggttaaagtgattctcctgcttcagcctccccagtagctgggattacaggcacccaccaccacactcagctgatttttgtatttttagtagagatgatgtttcgccatattggtcagrctgattttgaactcctgacttcaggtgatctgcctgccttggcctcccaaagtgctgagattacaggcatgagccacctcacccagccaatacattcttaaatactatagctttacagtatgttttaaaatctgatattgacatctgtccaccaattttttttttctcagcaaggctttggctatttgtatgcctttgcatttgtgtataaattttagaataaacttgtgaattttcttaacatgaaaactgttgggattttgatgtggatgcattaaatctataaatcaattgacagaa

SEQ ID NO: 8044 - DNA, 601 bp, Human
ttatgcacaattgcctaataacaagaactatcataagagactgccaaaaccgcagcgttgcacaaagaccaccacagtcttacacacacaaaaatatatatacttatgtgaggatctgcccagcaactgcctgcctaaccttggacggacactggctttgttattgatccttgtagccagggataattatctcaaaataacttatataacctcctcattttaccttcaaaaacccttgtcttttgttttcctcccctgaaggtgtctgtagtttactatgctatgttattccatgctgtastgcccactgccagataaacttattatctttggagaatgtctgtctttctgcccattattaagactgacataatctggtatcaagaaatgggacagaagtaagctcacctggaacagccgggcagcccctggaatcaagtgcagtaccaactgaatgaaccctttgtactctctgcttccaggagtcaccttttctgccctggtgattctcctcttaaattcttggactgcctccttttagtgagttcttttgacttgacttgggaccgcactggtttatccggttgcctcaagtagaaga

SEQ ID NO: 8045 - DNA, 601 bp, Human
cttaagtttagccatgtgaacatttcccattgtgtcagaaactgaatttagattcaattgtccttttataaaccattgagtttatattactattttactgtctcatgactaaaatttttaaatgaaagctataagatctttgtgtgtatatgtgtttatgtgtgtttagacacatatgcatgtgttatgttgtatgttgtatatacataatacaatctggcatagttggccagaaatcctttaaggaattcttttcaagttggcttagagataagatatgcaaatgacacttaaaagtgtaaaaaaaaaaaaaacccaaatgccttttagctcatgggattcatatgaatctttgataaataaattggttttaaatttgttggtaaaataaaaatttgtttcagaattgttagcttacattttgttgcctgggtttgctggttagacaggattacattgatctctgttagatgttttacagtcataaaactataaattcagcttaggccaggtgcagttgctcatgcctgtaatcctagcactttgggaggccaaggtgggtggatcacctgaggtcaagagttcgagaccagcctgacca

SEQ ID NO: 8046 - DNA, 601 bp, Human
gaaaagactccagtaattactcttgcttacaggtttctgataacactaaactcagtaggccaagcgaaaatttccagaactctgataaagaaactgatacattcatgaaactgctaacaaaaatcaagcagaacaaaaattaattacatgaagtgaaataactaacaaagatgatgttttatgacttttatttgaaacattgttgtttctttacttaaaacgtttcagttgcagatttaaggaaactttccctcttaagctaattataatttacagctatttgacaaaagtatacctttgttttttttttgtttttttttgtttttttttgagacggagtctcgctctgtcgcccgggctggagtgcagtggcgcgatctcggctcactgcaagctccgcctcccgggttcacgccattctcctgcctcagcctcccgagtagctgggactacaggcgcccgccaccacgcccggctaattttttgtatttttagtagaggcggggtttcaccgtgttagccaggatggtctcgatctcctgacctcatgatccgcccacctctgcctcccaaagtgctgggattacaggcgtgagccacc

SEQ ID NO: 8047 - DNA, 601 bp, Human
cagtaattactcttgcttacaggtttctgataacactaaactcagtaggccaagcgaaaatttccagaactctgataaagaaactgatacattcatgaaactgctaacaaaaatcaagcagaacaaaaattaattacatgaagtgaaataactaacaaagatgatgttttatgacttttatttgaaacattgttgtttctttacttaaaacgtttcagttgcagatttaaggaaactttccctcttaagctaattataatttacagctatttgacaaaagtatacctttgttttttttttktttttttttgtttttttttgagacggagtctcgctctgtcgcccgggctggagtgcagtggcgcgatctcggctcactgcaagctccgcctcccgggttcacgccattctcctgcctcagcctcccgagtagctgggactacaggcgcccgccaccacgcccggctaattttttgtatttttagtagaggcggggtttcaccgtgttagccaggatggtctcgatctcctgacctcatgatccgcccacctctgcctcccaaagtgctgggattacaggcgtgagccaccgcgcccggcc

SEQ ID NO: 8048 - DNA, 601 bp, Human
tcttgcttacaggtttctgataacactaaactcagtaggccaagcgaaaatttccagaactctgataaagaaactgatacattcatgaaactgctaacaaaaatcaagcagaacaaaaattaattacatgaagtgaaataactaacaaagatgatgttttatgacttttatttgaaacattgttgtttctttacttaaaacgtttcagttgcagatttaaggaaactttccctcttaagctaattataatttacagctatttgacaaaagtatacctttgttttttttttgtttttttttktttttttttgagacggagtctcgctctgtcgcccgggctggagtgcagtggcgcgatctcggctcactgcaagctccgcctcccgggttcacgccattctcctgcctcagcctcccgagtagctgggactacaggcgcccgccaccacgcccggctaattttttgtatttttagtagaggcggggtttcaccgtgttagccaggatggtctcgatctcctgacctcatgatccgcccacctctgcctcccaaagtgctgggattacaggcgtgagccaccgcgcccggccaaaagtatac

SEQ ID NO: 8049 - DNA, 601 bp, Human
cagaactctgataaagaaactgatacattcatgaaactgctaacaaaaatcaagcagaacaaaaattaattacatgaagtgaaataactaacaaagatgatgttttatgacttttatttgaaacattgttgtttctttacttaaaacgtttcagttgcagatttaaggaaactttccctcttaagctaattataatttacagctatttgacaaaagtatacctttgttttttttttgtttttttttgtttttttttgagacggagtctcgctctgtcgcccgggctggagtgcagtggcgygatctcggctcactgcaagctccgcctcccgggttcacgccattctcctgcctcagcctcccgagtagctgggactacaggcgcccgccaccacgcccggctaattttttgtatttttagtagaggcggggtttcaccgtgttagccaggatggtctcgatctcctgacctcatgatccgcccacctctgcctcccaaagtgctgggattacaggcgtgagccaccgcgcccggccaaaagtatacctttgtaaactaaagtggaaaaatttactttttatccctatttgatcctatcaa

SEQ ID NO: 8050 - DNA, 601 bp, Human
agatgatgttttatgacttttatttgaaacattgttgtttctttacttaaaacgtttcagttgcagatttaaggaaactttccctcttaagctaattataatttacagctatttgacaaaagtatacctttgttttttttttgtttttttttgtttttttttgagacggagtctcgctctgtcgcccgggctggagtgcagtggcgcgatctcggctcactgcaagctccgcctcccgggttcacgccattctcctgcctcagcctcccgagtagctgggactacaggcgcccgccaccaygcccggctaattttttgtatttttagtagaggcggggtttcaccgtgttagccaggatggtctcgatctcctgacctcatgatccgcccacctctgcctcccaaagtgctgggattacaggcgtgagccaccgcgcccggccaaaagtatacctttgtaaactaaagtggaaaaatttactttttatccctatttgatcctatcaaaattcagaaactacatgagtattcttatgttttttaatggcagtatatatgtttgtgtaagttcaataagaatctgctttctttataacagaat

SEQ ID NO: 8051 - DNA, 601 bp, Human
gatgttttatgacttttatttgaaacattgttgtttctttacttaaaacgtttcagttgcagatttaaggaaactttccctcttaagctaattataatttacagctatttgacaaaagtatacctttgttttttttttgtttttttttgtttttttttgagacggagtctcgctctgtcgcccgggctggagtgcagtggcgcgatctcggctcactgcaagctccgcctcccgggttcacgccattctcctgcctcagcctcccgagtagctgggactacaggcgcccgccaccacgccyggctaattttttgtatttttagtagaggcggggtttcaccgtgttagccaggatggtctcgatctcctgacctcatgatccgcccacctctgcctcccaaagtgctgggattacaggcgtgagccaccgcgcccggccaaaagtatacctttgtaaactaaagtggaaaaatttactttttatccctatttgatcctatcaaaattcagaaactacatgagtattcttatgttttttaatggcagtatatatgtttgtgtaagttcaataagaatctgctttctttataacagaatagaa

SEQ ID NO: 8052 - DNA, 601 bp, Human
ccagctataagatacgaaatgatagaattgctctagattctctattggttaaataaggagatatttgtgctattgccaataatacatgctgtacctggataaacccctttgggcaagttgtgatgcaaatactcaagaaaataggccacatagttacaacaggacttacctaattccccatggtcatttggctgattcagtcagttgctttcaagcctaggttcttggctcaatattattacataaactagaattttcctattactattaattttactttgtatttttctttataaacttygtacttattgcttgtcaaatttcagcagaagtacaactcctgagagaataatgctggctcagagttttgagatgataacccttgtctatgaaactgatgaagttggacttaacaacgaacactccccacagaactcctgatgctcaaatgtggctaaagggtttcatactgactcctaatcagcaatcacttccctctgacatgggatcagagttacccagaacaagttcatcctggcactgatggatgatgaaaatctaaccacagaatgattagtcagcaatggttttagagacgtat

SEQ ID NO: 8053 - DNA, 601 bp, Human
cttttctccttctgagaacccaattagatgcatgagatacaatttcaagtccaatgtatctcttatgctcctttccccaattctttttcttccctatctaatctgggtattttctactatcctatcttccagtttgctaatctttccttctgtgtctagtctaccatcgaatatccttattcaatttttaattttactgtatttttaaattcagaatttccactttatttgttttttacagataattgtctagtgagtttctccacacagtaatattttttgaacattttaaaagtaatagatattttagtcaatgactgatgatttaagtttgttacctgcatcattttttaatctctttctattgtctgtttttttctcttttatttttagtgaatctgtcctgtctcttgacatacctgtttttgttttgttttgcatttttgttgttgttgttggttttggtgtgtttaaacattgtttatcaaaatcggtagaattttgtaaatgatatgatcttccttgagggacagtttactttttttctggcagatatatagatatagatataaatatagatatagatatatatccaattagg

SEQ ID NO: 8054 - DNA, 601 bp, Human
tatataaatacataaataattagcactacttaatagagaaaccataagttatctgaaacatattgtcggcagagggggaaaaagaagaaagcagaaattcattttagaatgagaaacatattaggtgtgaaaaaactatataccactgtcatatacaaaaatataatatgtgtaggtctatttgtgaaaggcttttactctttaggttatatagttcttgaatttttaaagctgttcagacactgtaccacaacctcatatcacagtggtacccagaaaatccaaatagtagtacttgtgwaaatagatttctatttcagcctctttaaaggcagttatgtagatactcttaattttgaatttttggaaatagggaggatcattatttcctaaaattatagcacttataagtggtagatagggaattctctcgtaggtctcagactccagagcacaaacgaccaacctttatgaaatatgaacttcctggcttcacttccatctgggaggagaaatgtattcccccttatgctaatccattccattcaggacaatgctcatgggtagaatcctatttattatagtatgttaaactctactt

SEQ ID NO: 8055 - DNA, 601 bp, Human
tttcccctgctagtaaaagtgttaaaacatccttctttcttttgtatctcaatatctagcatgatacttaccccacagttgatagtcaaaatgtgtctggggaatgatcaaagtaatgcagacatttaagattgtgagccctgctaaacctattcttcagcaagaacatgtgtgttctctatgtggggtagttagaaggaagttagtattcttcagcggaacactttaaatgtgaccatatagggaagaaacgtatgtgtatgtgtgtgcgtgtgcctgtgtgcatatgtgtgtgcgtgtwgcatattcagtcatggtttctgaaggtgattacaatttttaacactagcagttcaagtccaggcatctaccctgtggcttctgagtttacagattttcaccctttcacaaatgtgcaaaaatgttactggtggtcatgcagaagagatgtacttggtcctgaataaataatgactttcctgaattagttatctgaggactctcttgattgtcaatccatgaggttagtgggcgactgtgtctgtcttgttcgtcttcttgtctccccatccaagatctagaaacttagtccctgctggtt

SEQ ID NO: 8056 - DNA, 601 bp, Human
tttcatcaacttgaaaacattcagtgagtttgattggtacaatattgatttattaattcaggaaaaatcagacacttcttaataagaaagtatgtccttttaaaaattataagtcttctcctatggccttcactatgactttatatgcaaagttgtataagttcatttattttacgttgctgatatttttgtacatgaaacaattttccattatattaggttgggttagtgttggcacataaaaattttttcatttctgtatgttaattttgtcacaagataccttgccaaaatgttttaktcctttaaatgcatttgtaatttttaaaatcttgggcataaagacagaccatctgctaataatgatcttggctctttattatattgtttgtctaatttttattaaattgcacttaaactataacaatggttgttataaacatctcccatctctaacttagatcactccctgttaaccataatgttggatttcttttgaaaagattattatatatacctgttggcattagtatttaagcaattttctagaatagtgtcttctcaggggatgactctaggccagtgatatatttgagagtgt

SEQ ID NO: 8057 - DNA, 601 bp, Human
atatttgagagtgttcatcatgtaagacagttgtttaatccatgggatagcaggaaattttggaaaatatagaggaaagaaggttcagggctgagccatggggcaatccaagatttagatatttgtataaagatgagaatccagtaatatagcctaagaagaattcgtaatccaataatagctaatagaagaaagtatttcccaaaagggcagggtcaactctcaaaagcttctgagaggttatataagatggtacagagaattggccactgggttggggtcattggagacattgctgaaraagtacttgtcacatagcagtatcttgaggtaattggattgggttgagatgagactggagttaagagaacagcagcaaacttctttttgggaagtttactttaaattgtactttgctgctatgcttttgcaacacaaggtgttttctatcttttactcatctatgttttgcccggttcctatgttactcctcccggcaaccaccaccaccactgctttcccctattagaatgaagcagttctaactaagcctccttttcctcctccttattctcctgcttctccttttagctgcctttga

SEQ ID NO: 8058 - DNA, 601 bp, Human
gggaggccaaggcgggtggattgcttgaggccaggagttcaaaaccagcctggccgacaggtgtaatcctgtctctactaaaaatagaaaaaaaaaatcatctgggtgtggtggcgcatgcttgcaatccgagctactctggaggctgaggcaagagaattgcttgaacccaggagacagaggttgcagtgacccaagattgcaacactgcactgccagcactcaagcctggggacagagcaagactctgcctaaaaaaaaaaaaaaaaaaaaaaattatgaggacacataagaagcatasttaattttattgtatttgtgaaattgtgtgagtaggaggatgccaatgtcacagatttggtgaagttttccttggaccttgaagaatgattggaaatttacctgataggtatatgataatgactgaaacaaaattggtagtgatttgtggtagtggctaaatagaagttgtgaagtgaggcagcaaaataataaacttacaaaaattagccaggcacgtgcctgtagtcccaactgctcaggaggctgaggcaggagaattgcttgaacccaggaggcggaggttgcagtgagccgagat

SEQ ID NO: 8059 - DNA, 601 bp, Human
gacagaggttgcagtgacccaagattgcaacactgcactgccagcactcaagcctggggacagagcaagactctgcctaaaaaaaaaaaaaaaaaaaaaaattatgaggacacataagaagcatacttaattttattgtatttgtgaaattgtgtgagtaggaggatgccaatgtcacagatttggtgaagttttccttggaccttgaagaatgattggaaatttacctgataggtatatgataatgactgaaacaaaattggtagtgatttgtggtagtggctaaatagaagttgtgaastgaggcagcaaaataataaacttacaaaaattagccaggcacgtgcctgtagtcccaactgctcaggaggctgaggcaggagaattgcttgaacccaggaggcggaggttgcagtgagccgagatcatgccactgcactccaacctgagtgacagagcaagactctgtctctaaaaaaaaacccaaaaaaatatggaatgcatgaagaatttactcttttttacctctctgtctgcaataaattagcctttcctaatgcattatattttaattgttaactttttaaaaaatgttgtggat

SEQ ID NO: 8060 - DNA, 601 bp, Human
caatagatacatggtgaaaaaagaattggaaattggttactatattctctgatattttaaaaagatatgtgaattgttatttatcaggaaagaaaatgtgccgacgccagaatattaacactttattgtctaactttacacaaaaatatgggacagaaattatccacaatgaaaacaacggaatgttgaaatctgaacacatatgccagtgtttagttcatcttttctgaagaggcacagaagccaatgaggcacattcaggaaaattacttaaaatgtgaattacttaaaattacttaaratgtgaataaatttgtcaccatgaatacatataccctgaaacgtagaaactggttctatgtaactggaatgcattgcccctcaggaataatgcaactgatgatcatggcttcccacatctgtgtgtgaaggaacagttcaccatatccagaccacactgctgatggtactacagtttgcctctttctccccacagcctgcattattggaatcatttgcacatccacccatgaaaaagattagagcatttatgcacattgaaaggtgactggagttcagaaaatctaggttctaaaaccaa

SEQ ID NO: 8061 - DNA, 601 bp, Human
gacgccagaatattaacactttattgtctaactttacacaaaaatatgggacagaaattatccacaatgaaaacaacggaatgttgaaatctgaacacatatgccagtgtttagttcatcttttctgaagaggcacagaagccaatgaggcacattcaggaaaattacttaaaatgtgaattacttaaaattacttaaaatgtgaataaatttgtcaccatgaatacatataccctgaaacgtagaaactggttctatgtaactggaatgcattgcccctcaggaataatgcaactgatgrtcatggcttcccacatctgtgtgtgaaggaacagttcaccatatccagaccacactgctgatggtactacagtttgcctctttctccccacagcctgcattattggaatcatttgcacatccacccatgaaaaagattagagcatttatgcacattgaaaggtgactggagttcagaaaatctaggttctaaaaccaacactactaatagatagagagctggccttgggcaaatcatttagccccagcatgcttgagtttcctcatctattaaataaattgaaggaagtcatggatcctt

SEQ ID NO: 8062 - DNA, 601 bp, Human
gcacatccacccatgaaaaagattagagcatttatgcacattgaaaggtgactggagttcagaaaatctaggttctaaaaccaacactactaatagatagagagctggccttgggcaaatcatttagccccagcatgcttgagtttcctcatctattaaataaattgaaggaagtcatggatccttctgacattttaccaaaaaaaatgtgtattggtatatttttccagggatagatctgtgttctgccagttatggttcttgattacaaacaacaaaaccaacttcattaaaagggataaaaaaatattttattagaaggctttaggctcagaatgcaactttgaacaattagctcctgcagcaacctggggaagcaaggcactgccaagaaccagttcctgctgccatcacttctgaatgtcagccactgcaggctgagcttcaaggctcccagaattgctatgctgttgcatttgccacactgcccacagacgttgtgcctttgctttcaccctcaagaataaaagccctgaccaagggtgtctgatgtgtgcctgttctagctgccagggtataggaagagggaatatcgttgaag

SEQ ID NO: 8063 - DNA, 601 bp, Human
catcacttctgaatgtcagccactgcaggctgagcttcaaggctcccagaattgctatgctgttgcatttgccacactgcccacagacgttgtgcctttgctttcaccctcaagaataaaagccctgaccaagggtgtctgatgtgtgcctgttctagctgccagggtataggaagagggaatatcgttgaaggagggacccctgcctcctgctgaacctgggactacctccaagtagagattagttgaaggtcagccagcacaacactgtattgccatgtctttcaccagattctcaaagggatcgtgaccccatcatgtcagctagaaaatattatgaatcattgcattagattatctttaattacagctctgaaattatatgatcctaaatactaatttttctttcccccatcatccaccaactcagaatttctttaacaagatacaagttcagcaacagagtgactaacaacattgcaaggtcagccctgaagcatcttgtgattatttcagtgggtgtgtaattatgatggttgggctaatgacagggagtaacagatgtctcggagcactgtcacccaagcaaatttctggcaaa

SEQ ID NO: 8064 - DNA, 601 bp, Human
acattggaagagatgatgaattgaactataagcagctgatgggaacctcatgcttttggatttcataagtgtcataactctgccaacagtcttgtcccttgtgggctccttgaaagctgtttacggaatcatcgggaaagattttggctcctgttgggcgtgcgacttcttctaagccagaaaagcctcaacatctgtgcagtgtggatctcatctctgtgcatatgggctgtgttatcccaagagaaaatagtccccaattatatgagttcatcctcatgaactcctgcaagaactcccrtgggtatatcctggtgcctgacagtgcctgctggtaagatgtggctcctgtcccacagccttcaaaggagactggtggcaagtgtcagcctgagagcttagttgaaacttagagctccctccccagagtacaagcatatttaaggaaattcatgattgcacaatatgaggggcagggtaggatcaaggatgacaccaggtttctgttttgagcaactgaatggtggaggagactatgcttgtcttgaccagttgtctccatttcttgaaaaattggtttcttcacagagagcaacagaga

SEQ ID NO: 8065 - DNA, 601 bp, Human
atctctctctctcattatcatatgctcaaagctaggataaaggttagtgctcaatatttttatttgaataaatgatcaagtaaaggattcacaattaaggagaatgagaaaggaagaactattccagttttggatacaggattcttcaagttgaggtgaggatgtgatttggaccttgaacaactagtatttagatgtgcagaaataggatgtgaagaatattttaggcctgggaaagctgggcaaaagcacacaggtgaaaagttatttattagatattgaaggaaaatatcgatttcattttttttttttacatcaagagctctttctcagctgcttctgtacccatcattagaaaggatttttttcacatattacttactcatgtattatttataatatatattatgtcaccttcatttcttatacttggctcatctttagatatcaggtctttaaaaatattgttaaattggtgtttttgctttcaaaattaaaaaaatatatagagagaaatggaaaccacaaaataaaaatcacccattaattgatcatcctagaataatatctgatgacactatgttgtatttcttcctaggtt

SEQ ID NO: 8066 - DNA, 601 bp, Human
ctcagactaaccctttcttaactgaacaatacagtcagaatgtgattgtctccaaattacatcttaaaattgcacacctgtttcgtgaatttgtaagaggatcagttagtcctgtgtttggctgaaggtgatagacacaaatactgagtcttcaggttgtcattccagggttggatggtgaggcgactgcctgagcaccacagtgtccctgaaccccatctctctcttctgctctgcccttccagtatgacgtttatcattgttatggtttggctgtgtccccacgcaaatttcatcttgrattgtagtttctataatccccaagtgtcgtgggagggaccaagtgggaggtaattgaatcacgggggtggttttctccatgttattctcatgatagtaagttctcacgagatctgaaggttttataaggggcttcccccttcactcgactctcatacttcttcttcctgccatcatgtgacgaaggacatatttgcttccccttccaccataattgtaagtttcctgaggcctccccagtcatgcagaactgtgagtcaattaaacctctttccttccaaattaccgagtcttgggcagt

SEQ ID NO: 8067 - DNA, 601 bp, Human
tgacaactcaaagcatttgaatattaatgtattttgatgattggctgagctagataccaacttaacttcgtggaaggatataatagattagctaataataaaaaatcatcgccaggcacagtggctcacacctgtaatcccagcactttgggaggccgaggcgggcagatcatgaggtcaggagatcaagaccatcctggccaacacagtaaaaccctgtctctactaaaaatacaaaaattagctgggcgtggtggcacatgcctgtaatcccagctattcgggaggctgaggcaggagratggcttgaacccgggagtcggagggtgcagtgagtcaaaattgccactgcgctccagcctggtgacagagcaagactccatctcaaaaaaataaaataaaataataataaataaataaaaaatcatctattttcttgcataacattttatattatttgcaatgagatgccataaaattattcttaataatattgtaaatcaaaggcagaatatcaacttctaaaaggggaaaaattgtctcatactacaacatggaaggatctttaagatatgttaaataaaataagccagtcatgaaa

SEQ ID NO: 8068 - DNA, 601 bp, Human
tgtactcaatttaacaattattcattgagtagataggggcgtaggggtgccagttttctaacttggctctactctacagtttgatttgtgggtaaaaatgagaaagatgttttgaaaaagacaatttcaatctcctccaagtttttgaagatccactgtgtctcaggcattgtgttaggcactctgaagactacagtgctgacagaagtaatactcagaaaattcatagtagagtagtggattcatttgacacataactatataccatgagatggaagtcaaaaaagttccacaggaggtaaaaaaaaaaaaataaggtattacagaaattcagaggagagacaatgagtctcacttagggatattaggtaaatcttcacagaagggtagtcgctttttgctgagctttgaaaattactcagaacctgaatgtgtatagtaagggaaaggtacttctacctctgcaaaaacatgaggtcagaaaagcatgacaaatgtgcaggaaacaatgaatgggccagtttggttaaagggagaagagaaggaatacaattggaaatgtagcttctgtttttcaagaagctaaaacataacaaaggct

SEQ ID NO: 8069 - DNA, 601 bp, Human; identical to SEQ ID NO: 3170

SEQ ID NO: 8070 - DNA, 601 bp, Human; identical to SEQ ID NO: 3171

SEQ ID NO: 8071 - DNA, 601 bp, Human; identical to SEQ ID NO: 3172

SEQ ID NO: 8072 - DNA, 601 bp, Human; identical to SEQ ID NO: 3173

SEQ ID NO: 8073 - DNA, 601 bp, Human; identical to SEQ ID NO: 3174

SEQ ID NO: 8074 - DNA, 601 bp, Human; identical to SEQ ID NO: 3175

SEQ ID NO: 8075 - DNA, 601 bp, Human; identical to SEQ ID NO: 3176

SEQ ID NO: 8076 - DNA, 601 bp, Human; identical to SEQ ID NO: 3177

SEQ ID NO: 8077 - DNA, 601 bp, Human; identical to SEQ ID NO: 3178

SEQ ID NO: 8078 - DNA, 601 bp, Human; identical to SEQ ID NO: 3179

SEQ ID NO: 8079 - DNA, 601 bp, Human; identical to SEQ ID NO: 3180

SEQ ID NO: 8080 - DNA, 601 bp, Human; identical to SEQ ID NO: 3181

SEQ ID NO: 8081 - DNA, 601 bp, Human
cccagaagcagtgatggggaggggtcctgctctctcccaataccccaacttcccttacggctcacctcccatggctgtccttgtggaagtccagtgaaaatccaaactggctgccattggggcctgcatagaaggtgagctgcactgggtccaggttcaaggcccaggctggaggggcagcacaaggtcccaagagcagcagcacccactccagaagccagagggcttgcagtggacacaaagctctggccatcttccttcttccacaacctcccaggcaggaatgggccagctcctcctgcttcccttcagattcctccacaggaagtcttttcttatcaaactggaaccccaagtaacttgctgagcaacgggcagagcaaagggctatagcccctggactcatggtggctagaattgccaggaagtgggtgaggccacccagagggtggatgctcatggctgaaagccatgactcctcccctttcctgagaatagtttattaccatgtcctattggttctgcctatcaatgatgtctcttgaatctttaccccatctctactaccaccgtgctagtccaagccaccatcactttctgc

SEQ ID NO: 8082 - DNA, 601 bp, Human; identical to SEQ ID NO: 1244

SEQ ID NO: 8083 - DNA, 601 bp, Human; identical to SEQ ID NO: 1245

SEQ ID NO: 8084 - DNA, 601 bp, Human; identical to SEQ ID NO: 1246

SEQ ID NO: 8085 - DNA, 601 bp, Human; identical to SEQ ID NO: 1247

SEQ ID NO: 8086 - DNA, 601 bp, Human; identical to SEQ ID NO: 1248

SEQ ID NO: 8087 - DNA, 601 bp, Human; identical to SEQ ID NO: 1249

SEQ ID NO: 8088 - DNA, 601 bp, Human; identical to SEQ ID NO: 1250

SEQ ID NO: 8089 - DNA, 601 bp, Human; identical to SEQ ID NO: 1251

SEQ ID NO: 8090 - DNA, 601 bp, Human; identical to SEQ ID NO: 1252

SEQ ID NO: 8091 - DNA, 601 bp, Human; identical to SEQ ID NO: 1253

SEQ ID NO: 8092 - DNA, 601 bp, Human; identical to SEQ ID NO: 1254

SEQ ID NO: 8093 - DNA, 601 bp, Human; identical to SEQ ID NO: 1255

SEQ ID NO: 8094 - DNA, 601 bp, Human; identical to SEQ ID NO: 1256

SEQ ID NO: 8095 - DNA, 601 bp, Human; identical to SEQ ID NO: 1257

SEQ ID NO: 8096 - DNA, 601 bp, Human; identical to SEQ ID NO: 1258

SEQ ID NO: 8097 - DNA, 601 bp, Human; identical to SEQ ID NO: 1259

SEQ ID NO: 8098 - DNA, 601 bp, Human; identical to SEQ ID NO: 1260

SEQ ID NO: 8099 - DNA, 601 bp, Human; identical to SEQ ID NO: 1261

SEQ ID NO: 8100 - DNA, 601 bp, Human; identical to SEQ ID NO: 1262

SEQ ID NO: 8101 - DNA, 601 bp, Human
ttttgggagatggagttttgcactgttccccaggctggagtgcagtggtgtgatctcggctcactgcaacctctgcctcccaggttcaagtgattctcctgcctcagcctcctgagtagctggggctacagacatgtgccaccatacccggctaattttttgtatttttagtagagacgggatttcactgtgttggccaggctgatctcaaactcctgacctcgtcatccacctcccaaagtgctgggattacaggcgtgagctaccacagctggctggtttttttttgtttgtttgtttgttttgttttttgtttttaagagatggattctggctgtgttgcccaggatgaactcaaactcctggacttaagtgatcctcccgccttgaccttctgagtagctgggacaacagatgtgctccactgtgcctggcctggattctttttattggagtataaatgaaagggcagacagtggtctaaagtctgccctttcaaaattttaattttgaattttttttagagagcccacagcctgaagaaccatgagccaattaaacattttttctttattttttttttaaagaagagtagagagcc

SEQ ID NO: 8102 - DNA, 601 bp, Human
gtagctggggctacagacatgtgccaccatacccggctaattttttgtatttttagtagagacgggatttcactgtgttggccaggctgatctcaaactcctgacctcgtcatccacctcccaaagtgctgggattacaggcgtgagctaccacagctggctggtttttttttgtttgtttgtttgttttgttttttgtttttaagagatggattctggctgtgttgcccaggatgaactcaaactcctggacttaagtgatcctcccgccttgaccttctgagtagctgggacaacagaygtgctccactgtgcctggcctggattctttttattggagtataaatgaaagggcagacagtggtctaaagtctgccctttcaaaattttaattttgaattttttttagagagcccacagcctgaagaaccatgagccaattaaacattttttctttattttttttttaaagaagagtagagagcccagaaataaaccctcacataatgtagtcaaatggttttttttttttttgagatggagtttcaccctttttgcccaggctggagtccaatgtgcggtcttggctcactgcatcctc

SEQ ID NO: 8103 - DNA, 601 bp, Human
tgtgttgcccaggatgaactcaaactcctggacttaagtgatcctcccgccttgaccttctgagtagctgggacaacagatgtgctccactgtgcctggcctggattctttttattggagtataaatgaaagggcagacagtggtctaaagtctgccctttcaaaattttaattttgaattttttttagagagcccacagcctgaagaaccatgagccaattaaacattttttctttattttttttttaaagaagagtagagagcccagaaataaaccctcacataatgtagtcaaatggttttttttttttttgagatggagtttcaccctttttgcccaggctggagtccaatgtgcggtcttggctcactgcatcctctgtctcccaggttcaagcgattctcaagcctcagtctcctgagtagctgggattacaggcatgcaccaccacgcccggctaattttgtatttttagtagagatggggtttctccatgttggtcagggtggtcttgaaatcctgacctcaggtgatccgcctgcctcggcctcccaaagtgctgggattacaggcgtgagccaccacgcctggcctcatca

SEQ ID NO: 8104 - DNA, 601 bp, Human
cattcattcagacttcccaacaagtggtaccaggtaaacggtatgtccacatggaaaataatgaatttgggcccttatcttataccgtgtgcaaaaattaactgaaaatggatcaaagacctaaatgtaaggcctgaaactataaaattcttagaagaaaacataggcaaaacctatgacattggatttggtattgatttcttggatttgataccaaaggcacaggcaacaaaagaaaaagacaaattgaacttcttgaaaatttaaaaaatttctgcatcaaaagacaacatcagtagtraaaaggtgttgtacagaatgggagtaagtatttgcaaatcatacatctgacaagggattaatatccagattatagagagaactcctaaaactcaacaacaaagaaacaaaagacccagttcaaaaacgtgaaagacattgtttcaaagaagatatagaaatggccaataaggacatgaaaagatattcagcatcagtagttattagggaaatgccaatcaaaacacaatgagatcccacctcacacccattggattggctgctattaaaaacaaaaaacccagaaaatagtgttagtgag

SEQ ID NO: 8105 - DNA, 601 bp, Human
gctgaagtgtgcagtttaaaatggttaaaatggtaaattttatgttgtgtgtattttaccacaaaaaaaaaaataggccccctggaaaaacatccgttgtgcatgtgtttgtgaaatggaggtgtggccagtggactctggccaccatcctgtgcctggtgctgtctgagagtcgccccggctggcatcagggccttctcgttgctgccctctctcccattgctcctttgctgagaggctgccctctctcttggctgaatttggctgaacataactgagtgggccaaatagtaagtgtgcragtgggtaggcacaagtcagtcctgccgcccagtgcttattaagcactgcatgaaaagggcacagaattccctggagtagaatgtgcccaagtttacgtaagtcacatacagctcaccgccaagcagcagccttgaagaccccacttcaagtgtgactgacagcagcggtgggtgcaggggaagggtgggtcacagctgccaccctgaggttgggtcggctcccaactccgcctctcctcccacctgctgctttcttttcatcctgcgtttccttgcttgcccctccccacacctgcaca

SEQ ID NO: 8106 - DNA, 601 bp, Human
gtgcatgtgtttgtgaaatggaggtgtggccagtggactctggccaccatcctgtgcctggtgctgtctgagagtcgccccggctggcatcagggccttctcgttgctgccctctctcccattgctcctttgctgagaggctgccctctctcttggctgaatttggctgaacataactgagtgggccaaatagtaagtgtgcaagtgggtaggcacaagtcagtcctgccgcccagtgcttattaagcactgcatgaaaagggcacagaattccctggagtagaatgtgcccaagtttacstaagtcacatacagctcaccgccaagcagcagccttgaagaccccacttcaagtgtgactgacagcagcggtgggtgcaggggaagggtgggtcacagctgccaccctgaggttgggtcggctcccaactccgcctctcctcccacctgctgctttcttttcatcctgcgtttccttgcttgcccctccccacacctgcacagacctttgtcagggggaacccaggtccccggggcctccaggtggagcgagcctgagcaacctgactttccaaacctgccgtccacccagcaggtcact

SEQ ID NO: 8107 - DNA, 601 bp, Human
cagggccttctcgttgctgccctctctcccattgctcctttgctgagaggctgccctctctcttggctgaatttggctgaacataactgagtgggccaaatagtaagtgtgcaagtgggtaggcacaagtcagtcctgccgcccagtgcttattaagcactgcatgaaaagggcacagaattccctggagtagaatgtgcccaagtttacgtaagtcacatacagctcaccgccaagcagcagccttgaagaccccacttcaagtgtgactgacagcagcggtgggtgcaggggaagggtsggtcacagctgccaccctgaggttgggtcggctcccaactccgcctctcctcccacctgctgctttcttttcatcctgcgtttccttgcttgcccctccccacacctgcacagacctttgtcagggggaacccaggtccccggggcctccaggtggagcgagcctgagcaacctgactttccaaacctgccgtccacccagcaggtcactcgccttcctcgggccacactggctgcatcctccacttgttaaaagttggctctttaaactcataaattgtagatgctttttctccagtgc

SEQ ID NO: 8108 - DNA, 601 bp, Human
tgttatccctgtaattaaagccagttgctgaagcacagtaggatgcgtgcactgtgatagactaataggaacaactttttctcttccacagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggtaaaggctttgtagccttgaagcagcccctgggggacagtgtgtagccacagggccctcartgtcacctgcctgtcactcacctgcctgtccagtgacagccctgccagggcatcggtggggatgtgggcttgattctggtgttgctgctgtgttcttggtattggggctttttgcaagtgtactcgtttagtcattcaacgcacatcttagggtctccctaatagctgtaggcccaggtgctgagggctgggcagacagcggaagatggaggagtaccttggtctttgtggagctcatgtgtgtttgtgccggagtttatccccttgtcccaaactctgaaggttatgcaaatgcacacc

SEQ ID NO: 8109 - DNA, 601 bp, Human
tcaggtggagacagcccgaaggtaaaggctttgtagccttgaagcagcccctgggggacagtgtgtagccacagggccctcaatgtcacctgcctgtcactcacctgcctgtccagtgacagccctgccagggcatcggtggggatgtgggcttgattctggtgttgctgctgtgttcttggtattggggctttttgcaagtgtactcgtttagtcattcaacgcacatcttagggtctccctaatagctgtaggcccaggtgctgagggctgggcagacagcggaagatggaggagtacyttggtctttgtggagctcatgtgtgtttgtgccggagtttatccccttgtcccaaactctgaaggttatgcaaatgcacaccctgccactcatgtttgtatagggcacgtttgtcacttgtttggacagcagttgttgagagtcacactatgacctggcacgtttgtattctttgacccagtaattttccttttaggactttgaccaaaggaaatggatgaaagtttgtataaaacaatggaatgcggctgggtgtggtggctcatgcctgtaatcccagcactttgggaggccaaggcg

SEQ ID NO: 8110 - DNA, 601 bp, Human
tgggcttgattctggtgttgctgctgtgttcttggtattggggctttttgcaagtgtactcgtttagtcattcaacgcacatcttagggtctccctaatagctgtaggcccaggtgctgagggctgggcagacagcggaagatggaggagtaccttggtctttgtggagctcatgtgtgtttgtgccggagtttatccccttgtcccaaactctgaaggttatgcaaatgcacaccctgccactcatgtttgtatagggcacgtttgtcacttgtttggacagcagttgttgagagtcacrctatgacctggcacgtttgtattctttgacccagtaattttccttttaggactttgaccaaaggaaatggatgaaagtttgtataaaacaatggaatgcggctgggtgtggtggctcatgcctgtaatcccagcactttgggaggccaaggcggggggatcacttgaggtcaggagttggagaccagcctggtcaacatggttaaaccccgcttctaccaaaaaaaaatacaaaaagccaggcgtggtggcacgcagctgtaatctcagctgctctggaggctgaggcgggagaatcact

SEQ ID NO: 8111 - DNA, 601 bp, Human
agtaccttggtctttgtggagctcatgtgtgtttgtgccggagtttatccccttgtcccaaactctgaaggttatgcaaatgcacaccctgccactcatgtttgtatagggcacgtttgtcacttgtttggacagcagttgttgagagtcacactatgacctggcacgtttgtattctttgacccagtaattttccttttaggactttgaccaaaggaaatggatgaaagtttgtataaaacaatggaatgcggctgggtgtggtggctcatgcctgtaatcccagcactttgggaggccraggcggggggatcacttgaggtcaggagttggagaccagcctggtcaacatggttaaaccccgcttctaccaaaaaaaaatacaaaaagccaggcgtggtggcacgcagctgtaatctcagctgctctggaggctgaggcgggagaatcacttgaaccccgggaggcggaggttgcagtgagctgagatcacgccactgaactccagcctgggtgagagagtgagctcctgtttcaaaaaaataaaataaaaaataaaaagaacgcaacctcagtgtccctaggggaatggtgattagga

SEQ ID NO: 8112 - DNA, 601 bp, Human
tattacttgacatattgaggaagtgtgatctatcccagcagaacgcagcacagccatgagaatgaataagccacagctgtgcatcccccacctgcggccgactacggcgtctaacacagggtgctaggcaaggagggcgcgtcgcgtgtggtgctgtttctgtcaggcttacaattggacagatctaagttgtattgtttaaggatgcagccaagtggtaaaacgtagtaaatcccagcaaaactgtggtcactctaagaagtcagtagtaatggtggcctcttggagaagtagaggtagygggctgagagggcccatacgagcatgttggggatgctggtggtgccctgtctcttgacctagtatactgatgttcactttgcaaaaatttgttcagctgacataaatgtatcatgagcttttctgtctgttttatatgtttttcaatttaaaaagtttttagaaacatagaaaaaaatcacagggaagtcaacagcacaggcacagtgacgaaggctttgttagctgtttaaaggaagagacgtagcgggcagtgtggcatgcacctgtagtcacagctgctcgggaggctgaggcagaa

SEQ ID NO: 8113 - DNA, 601 bp, Human
aatttaaaaagtttttagaaacatagaaaaaaatcacagggaagtcaacagcacaggcacagtgacgaaggctttgttagctgtttaaaggaagagacgtagcgggcagtgtggcatgcacctgtagtcacagctgctcgggaggctgaggcagaatcacttgagttcaaagctgtggtgagctacgatcaatccttgaatagccactgtactctagcctgggcaacatagcaagaccctgtctaaaaagaaagaattaggtatgtggagggtcttcttgtgattacatttttctgtttagaaaaaaaagcgataggctgggcgcagtggctcacgcctgtaatccccagcactttgggaggccaaggtgggcggatcacgaggtcaggagatcgagaccatcctggctaacacggtgaaatcccgtctgtactaaaaatacaaaaaattagctgggcgtgttggcaggcgcctgtagtcccagctactcgggaggctgaggcaggagaatggcgtgaacccgggaggtggagcttgcagtgagccgaaatcgcgccactgcactccagcctgagtgacagagcgagactctgtctcaaaa

SEQ ID NO: 8114 - DNA, 601 bp, Human
ataccaaaaattagccaggcatagtggcatgagcttggagtcccagctgctggggcggctgaggtgggaggatcacctgagccctgggagttcaggcttcagtgagccgtgatcacaccactgcactctggcctgggcgacagagtgagaccgtgtccccagaaaagaaaagacaaacgtccctctgcccactctgagctgtcagcgctgaacgcggcctgtgctatggaagcccatgtgggcgcctctgatatccttgcctcctgtctgtcagcctgcctgtttcccattccatttgtgtttatccttgaacagtatctataattgttcattgtaaaactccatgtatatagtatcatcttgaatgtattttttcatccgacattatctgttgctcttcatccatgttgacaagcgtgttgcccagaagttcacaaccaggagtgattccctttcccagtgggctcgtgcctgtaagtgtgggtttcaagttgtcactatgacagggagccaccagtggccttgaaagagccaggaccagggatgccagcctgtcagcggggcactcagcagccaggatgtctccaaccccaaggtgaag

SEQ ID NO: 8115 - DNA, 601 bp, Human
ctcaccctgaacgggatttatacacacatcactaaaaattatccctactacaggactgcggacaagggctggcaggtaaatgccttcagtttgttgttaaatagaggctgatggataccgagaagaaagtggagcggctgctgtctggaacacaggcacaggataggaaggtagaagggggggttggagcctcccgtgctgagaggaagaggagttgggggccggtgctgccatgctctgcctcaccttctttgtgtggagcagaaggaagcgtggttctggaggagcgtctaggcctgcrtgctttactgttgtggaaattcatgtgtctgcataggatttgtgaagtgtggattgtttgagatatttccctttgaccaatgcagttcatatttgaaatgtaggagaaatttaaaacccagcctatccttccctttggcattctcctgtcttcctcatctaatcctgctaatggacagaagttttgaagtttgcagagacagttttcaaaccgcattttaccaaggaacacttagaagacatcttaaccagttggccggggtaaaaaacagatgaacgtggtgtgccctgtctcagccgg

SEQ ID NO: 8116 - DNA, 601 bp, Human
ataggaaggtagaagggggggttggagcctcccgtgctgagaggaagaggagttgggggccggtgctgccatgctctgcctcaccttctttgtgtggagcagaaggaagcgtggttctggaggagcgtctaggcctgcatgctttactgttgtggaaattcatgtgtctgcataggatttgtgaagtgtggattgtttgagatatttccctttgaccaatgcagttcatatttgaaatgtaggagaaatttaaaacccagcctatccttccctttggcattctcctgtcttcctcatctartcctgctaatggacagaagttttgaagtttgcagagacagttttcaaaccgcattttaccaaggaacacttagaagacatcttaaccagttggccggggtaaaaaacagatgaacgtggtgtgccctgtctcagccggggagcccacctggtcgtggaaccccggggctacccccaagagacactttgaaatctgcaaaatattccctttggtcagctcacacaccaataatttttttttttttttttgagtcagagtctcgctctgttatgccaataattttaaccctttagattatgt

SEQ ID NO: 8117 - DNA, 601 bp, Human
actgttgtggaaattcatgtgtctgcataggatttgtgaagtgtggattgtttgagatatttccctttgaccaatgcagttcatatttgaaatgtaggagaaatttaaaacccagcctatccttccctttggcattctcctgtcttcctcatctaatcctgctaatggacagaagttttgaagtttgcagagacagttttcaaaccgcattttaccaaggaacacttagaagacatcttaaccagttggccggggtaaaaaacagatgaacgtggtgtgccctgtctcagccggggagccyacctggtcgtggaaccccggggctacccccaagagacactttgaaatctgcaaaatattccctttggtcagctcacacaccaataatttttttttttttttttgagtcagagtctcgctctgttatgccaataattttaaccctttagattatgtaggttttttctctgtgtatctgtgttgtgttggctgtttactggatgtatatgagaatcttgctatttgaaataatttggcagtgggtaggtttgaaatatagaatattaaaaacatagagaagaaatgtatgtatgcttatagt

SEQ ID NO: 8118 - DNA, 601 bp, Human
atctaatcctgctaatggacagaagttttgaagtttgcagagacagttttcaaaccgcattttaccaaggaacacttagaagacatcttaaccagttggccggggtaaaaaacagatgaacgtggtgtgccctgtctcagccggggagcccacctggtcgtggaaccccggggctacccccaagagacactttgaaatctgcaaaatattccctttggtcagctcacacaccaataatttttttttttttttttgagtcagagtctcgctctgttatgccaataattttaaccctttagaytatgtaggttttttctctgtgtatctgtgttgtgttggctgtttactggatgtatatgagaatcttgctatttgaaataatttggcagtgggtaggtttgaaatatagaatattaaaaacatagagaagaaatgtatgtatgcttatagttttttaattcattaagtaaccaggaacatctatagaatttctttgaggctttaatgagtaaatgatcctttaaaaaaacatctaaactacatggcttagtggtaaggatggtgcaggggcaactgttttctatttattgaaggggaaaaa

SEQ ID NO: 8119 - DNA, 601 bp, Human
atggacagaagttttgaagtttgcagagacagttttcaaaccgcattttaccaaggaacacttagaagacatcttaaccagttggccggggtaaaaaacagatgaacgtggtgtgccctgtctcagccggggagcccacctggtcgtggaaccccggggctacccccaagagacactttgaaatctgcaaaatattccctttggtcagctcacacaccaataatttttttttttttttttgagtcagagtctcgctctgttatgccaataattttaaccctttagattatgtaggtttttyctctgtgtatctgtgttgtgttggctgtttactggatgtatatgagaatcttgctatttgaaataatttggcagtgggtaggtttgaaatatagaatattaaaaacatagagaagaaatgtatgtatgcttatagttttttaattcattaagtaaccaggaacatctatagaatttctttgaggctttaatgagtaaatgatcctttaaaaaaacatctaaactacatggcttagtggtaaggatggtgcaggggcaactgttttctatttattgaaggggaaaaaccttttttgtttta

SEQ ID NO: 8120 - DNA, 601 bp, Human
atctgtgatcacaccactgcactccagcctgggtgacagagcaagaccctgtctcaaaaaggaaaaaaaaagcctaccagccacgtcttccatatttcctttgtggaggggcttgggggtctttaatcatggaaggtacagaatgagacccagcctcccctctggcccaccttgtgcccaccccccatacctggagtgtctataccctgtcctgcctgccttcctgtctacagcaagggggtatctcttaattgaccattaggaaaatgctggatttggagagtagttccatattcagttrcatgtcagggtctcttaacatattgcatgctaaattctggccgtatttactctataaaactgaggctgtgcttcaaactatatacatacacacacacactctctctctctctctctctctctcacacacacacacacacacacacacacacacacacacacaaccagataataacttctacccatgttccagtgaccatggctttatggctttgtcaaggagagaaactccacatggggtccagcttgctctgtgggagtgtgtgagggtccctcagagtttacagcttattctgatggt

SEQ ID NO: 8121 - DNA, 601 bp, Human
ttaatcatggaaggtacagaatgagacccagcctcccctctggcccaccttgtgcccaccccccatacctggagtgtctataccctgtcctgcctgccttcctgtctacagcaagggggtatctcttaattgaccattaggaaaatgctggatttggagagtagttccatattcagttacatgtcagggtctcttaacatattgcatgctaaattctggccgtatttactctataaaactgaggctgtgcttcaaactatatacatacacacacacactctctctctctctctctctctcwcacacacacacacacacacacacacacacacacacacacaaccagataataacttctacccatgttccagtgaccatggctttatggctttgtcaaggagagaaactccacatggggtccagcttgctctgtgggagtgtgtgagggtccctcagagtttacagcttattctgatggtttgagataccagttacctggggctttgtcagtgtgtttctaagaagctttattagactctaatgtgtttctcttaagtggtatttctgtgtgttttttctaacatccatttatttgagaact

SEQ ID NO: 8122 - DNA, 601 bp, Human
aatcatggaaggtacagaatgagacccagcctcccctctggcccaccttgtgcccaccccccatacctggagtgtctataccctgtcctgcctgccttcctgtctacagcaagggggtatctcttaattgaccattaggaaaatgctggatttggagagtagttccatattcagttacatgtcagggtctcttaacatattgcatgctaaattctggccgtatttactctataaaactgaggctgtgcttcaaactatatacatacacacacacactctctctctctctctctctctctcwcacacacacacacacacacacacacacacacacacacaaccagataataacttctacccatgttccagtgaccatggctttatggctttgtcaaggagagaaactccacatggggtccagcttgctctgtgggagtgtgtgagggtccctcagagtttacagcttattctgatggtttgagataccagttacctggggctttgtcagtgtgtttctaagaagctttattagactctaatgtgtttctcttaagtggtatttctgtgtgttttttctaacatccatttatttgagaactac

SEQ ID NO: 8123 - DNA, 601 bp, Human
gctaaattctggccgtatttactctataaaactgaggctgtgcttcaaactatatacatacacacacacactctctctctctctctctctctctcacacacacacacacacacacacacacacacacacacacaaccagataataacttctacccatgttccagtgaccatggctttatggctttgtcaaggagagaaactccacatggggtccagcttgctctgtgggagtgtgtgagggtccctcagagtttacagcttattctgatggtttgagataccagttacctggggctttgtsagtgtgtttctaagaagctttattagactctaatgtgtttctcttaagtggtatttctgtgtgttttttctaacatccatttatttgagaactacctatgaacaggacaaggctttcttgctaaagagggtggctggataaaggcctggcctcagttttgggggggcccaagtcaggacaggtcttttggggagcagagcccttggagcaaggctctcctggaccacagtcgtgaagtggcgaggaccccacgggacccctcatgcatgccctgctttctgtcgtctattgcaggtgcct

SEQ ID NO: 8124 - DNA, 601 bp, Human
ttgtcaaggagagaaactccacatggggtccagcttgctctgtgggagtgtgtgagggtccctcagagtttacagcttattctgatggtttgagataccagttacctggggctttgtcagtgtgtttctaagaagctttattagactctaatgtgtttctcttaagtggtatttctgtgtgttttttctaacatccatttatttgagaactacctatgaacaggacaaggctttcttgctaaagagggtggctggataaaggcctggcctcagttttgggggggcccaagtcaggacaggycttttggggagcagagcccttggagcaaggctctcctggaccacagtcgtgaagtggcgaggaccccacgggacccctcatgcatgccctgctttctgtcgtctattgcaggtgcctgcacagctcacgtcggcagggaatgacagactagcacacgtcaggcacccttctctgctgaactgctattaaacttgtttctgttgaaacattttctctcctgtctagatggaggtctgtaagtctacagctgcatctctttccccagtaaggccactcctgtgtcatttcatgcctcgtggc

SEQ ID NO: 8125 - DNA, 601 bp, Human
tcaggacaggtcttttggggagcagagcccttggagcaaggctctcctggaccacagtcgtgaagtggcgaggaccccacgggacccctcatgcatgccctgctttctgtcgtctattgcaggtgcctgcacagctcacgtcggcagggaatgacagactagcacacgtcaggcacccttctctgctgaactgctattaaacttgtttctgttgaaacattttctctcctgtctagatggaggtctgtaagtctacagctgcatctctttccccagtaaggccactcctgtgtcatttcaygcctcgtggctccagctaattaagcgggagagggattagtttctccagattcctcctagttcatggacattactctctctcttttttttttttttttgagatagagttttgctcttgttgcccaggctggagtgcaatggcgcgatctcggctcactgcaacctccgcctcccaggttcaagcgattctcctgcctcagcctcatgagtagctgggactacaggcttgagccaccacacccggctaattttgtatttttagcagagacggggttcctccatgttggtcaggctggtgttg

SEQ ID NO: 8126 - DNA, 601 bp, Human
cagtcgtgaagtggcgaggaccccacgggacccctcatgcatgccctgctttctgtcgtctattgcaggtgcctgcacagctcacgtcggcagggaatgacagactagcacacgtcaggcacccttctctgctgaactgctattaaacttgtttctgttgaaacattttctctcctgtctagatggaggtctgtaagtctacagctgcatctctttccccagtaaggccactcctgtgtcatttcatgcctcgtggctccagctaattaagcgggagagggattagtttctccagattccycctagttcatggacattactctctctcttttttttttttttttgagatagagttttgctcttgttgcccaggctggagtgcaatggcgcgatctcggctcactgcaacctccgcctcccaggttcaagcgattctcctgcctcagcctcatgagtagctgggactacaggcttgagccaccacacccggctaattttgtatttttagcagagacggggttcctccatgttggtcaggctggtgttgaactcccgacctcgggtgatctgcctgcctcggtctcccgaagtgctgggatta

SEQ ID NO: 8127 - DNA, 601 bp, Human
tgttgcccaggctggagtgcaatggcgcgatctcggctcactgcaacctccgcctcccaggttcaagcgattctcctgcctcagcctcatgagtagctgggactacaggcttgagccaccacacccggctaattttgtatttttagcagagacggggttcctccatgttggtcaggctggtgttgaactcccgacctcgggtgatctgcctgcctcggtctcccgaagtgctgggattacaggcgtgagccaccgcgcctggccaatgtactttgaatttctttctgtcctcagctgtacycttggctgtcagaatactgaccctcacgggctcttcctgtgccatgagattctctgagccgcccttcccagtgcctcagaccttattctgacttcctccctcctggcttacaacaaaagccaggtgttttgtattgtctacctatggtatagctttttggtcaatccacagaggacatctgagggtgaaatgagatggtctgaggaatcctatttgaaaagatgccatatgtctttcttttgtttgcatttacgtcctatgatttgattttttcatggtacaaaagtatttaataagtga

SEQ ID NO: 8128 - DNA, 601 bp, Human
ggcgtgagccaccgcgcctggccaatgtactttgaatttctttctgtcctcagctgtacccttggctgtcagaatactgaccctcacgggctcttcctgtgccatgagattctctgagccgcccttcccagtgcctcagaccttattctgacttcctccctcctggcttacaacaaaagccaggtgttttgtattgtctacctatggtatagctttttggtcaatccacagaggacatctgagggtgaaatgagatggtctgaggaatcctatttgaaaagatgccatatgtctttctttygtttgcatttacgtcctatgatttgattttttcatggtacaaaagtatttaataagtgacacttcagtacagaaaacacagagcttgtagcttgtcctttaaaaccaggacggccaagtgaaaagtcagtacagagtcttatttttactattaaacaaatcaaagggacacactgggcattgaactactatgctttttcttctttctagagatgacatacgtgttttctgataagtaatgtaccacacattgcactaaagcaaagcagcaaacagccagtaaagctgtgccctgcctgct

SEQ ID NO: 8129 - DNA, 601 bp, Human
catttacgtcctatgatttgattttttcatggtacaaaagtatttaataagtgacacttcagtacagaaaacacagagcttgtagcttgtcctttaaaaccaggacggccaagtgaaaagtcagtacagagtcttatttttactattaaacaaatcaaagggacacactgggcattgaactactatgctttttcttctttctagagatgacatacgtgttttctgataagtaatgtaccacacattgcactaaagcaaagcagcaaacagccagtaaagctgtgccctgcctgctgctccygccgggctggaccagtggaacaccatctcggtaggagaggaagaaaatgcagagtccctaacccagagagcctaacaaactggtttataccgaagtgatcttcagcaaacacgcaaacacactaacatgctgtaagaatgttttagtctatttctagcacacagcataaattcgtaggtgcccagtcaaataggaaggaacgccattgtagaaagcatttttgccttcacagcactaacacctaaaaagcacacggcatatagtactttgatctttaagtggataagcatggaagtccca

SEQ ID NO: 8130 - DNA, 601 bp, Human
caccagctgcttcatttttatggtgctgtaatgtggtggtgaaagctgccatgttgaatccagaaatccgctccagcagctgttcttcaatatatttttctaccaaaaaaatgtatgcaggctgggtgcggtggctcacgcctgtaatcccagcactttgggaggctgtggccggcagatcacctgtggttggagggttcgagaccagatgaccaacacggagaaactacatctctactaaaaatacaatattattagcggggtgtggtggtgcgtgcctgtaatcccagctactcaggargctgaagcaggagaattgtttgaacccacatggcggagactgcggtgagctgataccgcgtcattgcactccagcctgggcaacaagagcaaaactccgtctcaaaaaaagaaaaagaaaaaaagaaatgtattcattaaaaataggtgtgtaggtgagtttattctcttccgtgtcttcaaactccaggtagtacttgtccatgtaatttctctgtaataactggaactcgttatccatgataacgttctctaaatatccaaccacaacagcaaattcatcagaggtggaggagaaaga

SEQ ID NO: 8131 - DNA, 601 bp, Human
cttcatttttatggtgctgtaatgtggtggtgaaagctgccatgttgaatccagaaatccgctccagcagctgttcttcaatatatttttctaccaaaaaaatgtatgcaggctgggtgcggtggctcacgcctgtaatcccagcactttgggaggctgtggccggcagatcacctgtggttggagggttcgagaccagatgaccaacacggagaaactacatctctactaaaaatacaatattattagcggggtgtggtggtgcgtgcctgtaatcccagctactcaggaggctgaagcwggagaattgtttgaacccacatggcggagactgcggtgagctgataccgcgtcattgcactccagcctgggcaacaagagcaaaactccgtctcaaaaaaagaaaaagaaaaaaagaaatgtattcattaaaaataggtgtgtaggtgagtttattctcttccgtgtcttcaaactccaggtagtacttgtccatgtaatttctctgtaataactggaactcgttatccatgataacgttctctaaatatccaaccacaacagcaaattcatcagaggtggaggagaaagacagcacaaa

SEQ ID NO: 8132 - DNA, 601 bp, Human
aatccagaaatccgctccagcagctgttcttcaatatatttttctaccaaaaaaatgtatgcaggctgggtgcggtggctcacgcctgtaatcccagcactttgggaggctgtggccggcagatcacctgtggttggagggttcgagaccagatgaccaacacggagaaactacatctctactaaaaatacaatattattagcggggtgtggtggtgcgtgcctgtaatcccagctactcaggaggctgaagcaggagaattgtttgaacccacatggcggagactgcggtgagctgataycgcgtcattgcactccagcctgggcaacaagagcaaaactccgtctcaaaaaaagaaaaagaaaaaaagaaatgtattcattaaaaataggtgtgtaggtgagtttattctcttccgtgtcttcaaactccaggtagtacttgtccatgtaatttctctgtaataactggaactcgttatccatgataacgttctctaaatatccaaccacaacagcaaattcatcagaggtggaggagaaagacagcacaaagctctcttcttctaaggtgtccatcactgcagccccgagcaggctcc

SEQ ID NO: 8133 - DNA, 601 bp, Human
agatgaccaacacggagaaactacatctctactaaaaatacaatattattagcggggtgtggtggtgcgtgcctgtaatcccagctactcaggaggctgaagcaggagaattgtttgaacccacatggcggagactgcggtgagctgataccgcgtcattgcactccagcctgggcaacaagagcaaaactccgtctcaaaaaaagaaaaagaaaaaaagaaatgtattcattaaaaataggtgtgtaggtgagtttattctcttccgtgtcttcaaactccaggtagtacttgtccatgwaatttctctgtaataactggaactcgttatccatgataacgttctctaaatatccaaccacaacagcaaattcatcagaggtggaggagaaagacagcacaaagctctcttcttctaaggtgtccatcactgcagccccgagcaggctcctaccccgcctgtggcccaacctgcatgcagggcgtggcgggcggccgggttaaggtctcgcagccaaagctgcggcgtgctcactgcccagtcagggcagcacctgcgtgccaggcccagccctgggttagggccccgccgggccctctg

SEQ ID NO: 8134 - DNA, 601 bp, Human
atggcccagccctcctctccatgtcgcccatgaagtagctccatccacagggcccagatccctcccacacatggcctagccctcctctccatgtcacccatgaagtagctccatccacagggcccagatccctcccacacatggcctagccctcctctccatgtcacccgtgaagtagctccatccacagggcccagaggcattaggatggcacttggacaacccctgagatgggttgtaaagtgttattttatattttgtatgttggatttcttagtcacctttgacgatttgaaattcmggctgaggcttgcaattctaataaggttaattggggaatttagaaatgatttttggatagctccagattttgttttgagtgatcaccattttaacactttaatagcttaattttaaatctacacattaatgtaaattcacgaaatgtttctatgaacccatgacgttcgtccggctttggcctgagtcaggtcccagcgggggctttcttcagggtgtctgtcaactcttagctgggcttttttctgagatggagtcttgcttctattgcccaggctggagtgcagtggtgcgatctggg

SEQ ID NO: 8135 - DNA, 601 bp, Human
cgtgaagtagctccatccacagggcccagaggcattaggatggcacttggacaacccctgagatgggttgtaaagtgttattttatattttgtatgttggatttcttagtcacctttgacgatttgaaattcaggctgaggcttgcaattctaataaggttaattggggaatttagaaatgatttttggatagctccagattttgttttgagtgatcaccattttaacactttaatagcttaattttaaatctacacattaatgtaaattcacgaaatgtttctatgaacccatgacgttygtccggctttggcctgagtcaggtcccagcgggggctttcttcagggtgtctgtcaactcttagctgggcttttttctgagatggagtcttgcttctattgcccaggctggagtgcagtggtgcgatctgggctcactgcaacctcctcctctcggcttcaagcaattcttcagcttcagcatccttagtagctgggactacaggtgtgggccactgtgcccggatgatttttgtgtgggtttttttttttttttgagatggagtcttactctgtcgcccaggctggagtgcagtggcgc

SEQ ID NO: 8136 - DNA, 601 bp, Human
ggatagctccagattttgttttgagtgatcaccattttaacactttaatagcttaattttaaatctacacattaatgtaaattcacgaaatgtttctatgaacccatgacgttcgtccggctttggcctgagtcaggtcccagcgggggctttcttcagggtgtctgtcaactcttagctgggcttttttctgagatggagtcttgcttctattgcccaggctggagtgcagtggtgcgatctgggctcactgcaacctcctcctctcggcttcaagcaattcttcagcttcagcatcctkagtagctgggactacaggtgtgggccactgtgcccggatgatttttgtgtgggtttttttttttttttgagatggagtcttactctgtcgcccaggctggagtgcagtggcgcaatctcggctcactgcaagctctgcctcccgggttcacaccattctcccgcctcagcctcccgagcaactgggactacaggtgcccgccactacgccccgctaatttttcgtatttttagtagagacagggtttcaccgtgtttgccaggatggtctcgatctcctgacctcgtgatccgcccgcct

SEQ ID NO: 8137 - DNA, 601 bp, Human
aattttaaatctacacattaatgtaaattcacgaaatgtttctatgaacccatgacgttcgtccggctttggcctgagtcaggtcccagcgggggctttcttcagggtgtctgtcaactcttagctgggcttttttctgagatggagtcttgcttctattgcccaggctggagtgcagtggtgcgatctgggctcactgcaacctcctcctctcggcttcaagcaattcttcagcttcagcatccttagtagctgggactacaggtgtgggccactgtgcccggatgatttttgtgtgggtttttttttttttttgagatggagtcttactctgtcgcccaggctggagtgcagtggcgcaatctcggctcactgcaagctctgcctcccgggttcacaccattctcccgcctcagcctcccgagcaactgggactacaggtgcccgccactacgccccgctaatttttcgtatttttagtagagacagggtttcaccgtgtttgccaggatggtctcgatctcctgacctcgtgatccgcccgcctcggcctcccaaagtgctgggattacaggcgtgagccaccatgcctggccaattt

SEQ ID NO: 8138 - DNA, 601 bp, Human
gctttggcctgagtcaggtcccagcgggggctttcttcagggtgtctgtcaactcttagctgggcttttttctgagatggagtcttgcttctattgcccaggctggagtgcagtggtgcgatctgggctcactgcaacctcctcctctcggcttcaagcaattcttcagcttcagcatccttagtagctgggactacaggtgtgggccactgtgcccggatgatttttgtgtgggtttttttttttttttgagatggagtcttactctgtcgcccaggctggagtgcagtggcgcaatctyggctcactgcaagctctgcctcccgggttcacaccattctcccgcctcagcctcccgagcaactgggactacaggtgcccgccactacgccccgctaatttttcgtatttttagtagagacagggtttcaccgtgtttgccaggatggtctcgatctcctgacctcgtgatccgcccgcctcggcctcccaaagtgctgggattacaggcgtgagccaccatgcctggccaatttttgtatgttcagtagagacggggtttcaccatgttggccaggctggcctcaaactcctgacctca

SEQ ID NO: 8139 - DNA, 601 bp, Human
cgtatttttagtagagacagggtttcaccgtgtttgccaggatggtctcgatctcctgacctcgtgatccgcccgcctcggcctcccaaagtgctgggattacaggcgtgagccaccatgcctggccaatttttgtatgttcagtagagacggggtttcaccatgttggccaggctggcctcaaactcctgacctcaactgagccgctgcgcccgtctggctttttgtaatagaaagaatgatgcactgatgaggagctgggagggaaatttttcctgtgtacgttacgaaattatttcaragttcaaataaaaaaacaggtactttgccaagtcctctcttcctggaagatggtgtccatcctgattttcagcctcctgctcatttttcttttttgctggtttaccaaatactttatactggattaatttacttttaatggcatgacagattctgtaagctaattctgtgcgaaaaagtattttaacagaatggctcacatcagctctgtttgtctccaagcagggagaggttggcagctaagtcattgcctccacctggaatgctcagtgctgacagttgcagtcctgggtttcccacc

SEQ ID NO: 8140 - DNA, 601 bp, Human
ttatttcatcaaagtgccgcgttcccaggaagaaccaggcaaaggctcgttctggaggatagacccagcctctgaaagcaaattaatagaacaggcttttaggaaacgacggcctaggggcgtgccctgctttagaacccctctgggaccgctctcttctaggtaaggaaaaagaagaacaaaaggcctcacttcgtgcttactaaacttaccttcagtgtattgggaaaatttccttttgaaaatgaaggaactactaaatgcattatgattaaatgttgggatggggatttgagcaaamgtgttgggtgctgcccaggtgtttctggttctagtggctgaaacatttgagacgatttgcaaagtttaaactgcactcgacgcagtgattgttgcttcatggggctcatcgcatgttgttcataccagtgccacgtcgacgtttttcctttcccttggcacaggaaaagttctttaaaactactttttaggccgggcgctgtggctcacgcctgtaatcccagcattttgggaggccgaggcgggcggatcacctgaggtcaggaggtcgagatcagcctggccaatatggtcaaacccc

SEQ ID NO: 8141 - DNA, 601 bp, Human
ctccacagagaagaaacagccggactggaggcctgcctgtccctctgtaccttatactagtacctgattttataggccttggaaaactaatagcactgggagtgttttttaaaaatcaatgaaggttctttaaacgacactgagtagatgcctgaaataacttagaattaacctgtttcttagtttgtcattcaaaaatccatgaaacagcccccgcacccccaccccccgcaaaaaaatcaaaacaaaacaaaaacccatgaagtagacaaactagacactggaagcaaaaacatgtcctttttttttttttttttttttttttgagacagagtctcactttgtcaccaggctggaatcttggctcgttgcaacctctgcctcccaggttcaaagaattctcctgcctcagcttcccgagtagctgggactacaggcacacaccaccacacccagctgctaatttttgtatttttagtagagacagggtttcaccatgttggccaggatggtctcaatctcttgacctcgtgacctcatgatccacctgccttggcctcccaaagtgctgggcgtacaggcgtgagccaccacgcccagc

SEQ ID NO: 8142 - DNA, 528 bp, Human
ccagcggcagctaccacaggccatcaagcctgtcacctacactgtggccaccccagtgaccacctcgacctcccagccacccgtcgtgcagacggttcacgtcgtccaccagatcccagcggtgtcggtcaccagtgtggccggactggccccagcgaacacgtacactgtctctggacaagctgtggtcaccccggcagccgtgctggcccctcctaaggcagaggcccaggagaatggagaccacagggaagtcaaaggtaggcggaggggaaaggaggagaggggagaccacagggargtgaaaggtgggccgggggggaaaggaggagaggggagaccacagggaggtgaaaggtgggcgggggggaaaggaggagaggggagaccacagggaggtcaaaggtgggcggaggggaaaggaggagaggggagaccacagggaggtgaaaggtgggccgggggggaaaggaggagaggggagaccacagggaggtgaaaggtgggcagtgggggaaaggaggagag

SEQ ID NO: 8143 - DNA, 525 bp, Human
gcggcagctaccacaggccatcaagcctgtcacctacactgtggccaccccagtgaccacctcgacctcccagccacccgtcgtgcagacggttcacgtcgtccaccagatcccagcggtgtcggtcaccagtgtggccggactggccccagcgaacacgtacactgtctctggacaagctgtggtcaccccggcagccgtgctggcccctcctaaggcagaggcccaggagaatggagaccacagggaagtcaaaggtaggcggaggggaaaggaggagaggggagaccacagggaggtsaaaggtgggccgggggggaaaggaggagaggggagaccacagggaggtgaaaggtgggcgggggggaaaggaggagaggggagaccacagggaggtcaaaggtgggcggaggggaaaggaggagaggggagaccacagggaggtgaaaggtgggccgggggggaaaggaggagaggggagaccacagggaggtgaaaggtgggcagtgggggaaaggaggagag

SEQ ID NO: 8144 - DNA, 601 bp, Human
tcatgctggggaagtggtcgtggagtcggccgtcacgggattcccgtgggaggacctgcctgaaaagagatgagagtttctaatacattgagagggaaaaatactctcgcctcttgtagatttcctgggtgtggcctggaagcggcctgaaacggcgggagccgccgcgtgtcttttcccttggcctcgcgcgccctgtggcctgtggcggtgctatgctgctgagggtgggagagaggctgcttttctgtgcgctttgctctcagagtccgtccgaggccggtgcacagaaaaccgcacrgatgttctgacattgacaagtggagacaccagaacctccgcgccgacaccgggttatctaccttcgccctgccctgtggagtgtggaaagggtgggagtccctgctggctgccgagtcaactctggcattggggcctggctcaggtgtgggctcccgctgctctgggttgggtacatgtgggctgttgccggctgtgtggctgatcctggcgcttgcgggatctcaagcaggcaaatccgaagctaccgactaaaactgtctctgtgcccacgacacgctttctttgaaagagggtacag

SEQ ID NO: 8145 - DNA, 601 bp, Human
ggatctcaagcaggcaaatccgaagctaccgactaaaactgtctctgtgcccacgacacgctttctttgaaagagggtacaggtcagaaggctttatcacgacgtttgaatccttaccgaacgctacgaacagagaccttgaaacctgcaggtacctcctactctgactcagcaccaccctgcctctccccaaatttatggaagaacaaggtctggaaccttttctagggaagactgactacctggggttttttttgtttttaagtaatagcaacacttgctgcctgtagatagatcgcaragtttgcagtcatcagttacctgtttgaatgccttcgtccccaagccctgtgtctcctccttctcttctctctgggtaactgtggctgtggatgctctaaggtgataaacctggtggcactgcaggtagctgggaggagatggaagccgggagggctggcgattggagggcaggcggttggagggctggctattggagggcaggcggttggagggctggcggttggagggctggcggttggagggcaggcggttggagggcaggcggttggctttctggtcttagtcactcccagtctga

SEQ ID NO: 8146 - DNA, 601 bp, Human
aggtacctcctactctgactcagcaccaccctgcctctccccaaatttatggaagaacaaggtctggaaccttttctagggaagactgactacctggggttttttttgtttttaagtaatagcaacacttgctgcctgtagatagatcgcagagtttgcagtcatcagttacctgtttgaatgccttcgtccccaagccctgtgtctcctccttctcttctctctgggtaactgtggctgtggatgctctaaggtgataaacctggtggcactgcaggtagctgggaggagatggaagccrggagggctggcgattggagggcaggcggttggagggctggctattggagggcaggcggttggagggctggcggttggagggctggcggttggagggcaggcggttggagggcaggcggttggctttctggtcttagtcactcccagtctgaagacaaggcagaggcctagtgattcccagattcgatatgtgtcagaatcacccagaaggcttggctgttagaggccagagtgctgcgttccccagagttcccgactaggcctgtctggtgtggggcccaagaatgcatttctgaaacag

SEQ ID NO: 8147 - DNA, 601 bp, Human
gatagatcgcagagtttgcagtcatcagttacctgtttgaatgccttcgtccccaagccctgtgtctcctccttctcttctctctgggtaactgtggctgtggatgctctaaggtgataaacctggtggcactgcaggtagctgggaggagatggaagccgggagggctggcgattggagggcaggcggttggagggctggctattggagggcaggcggttggagggctggcggttggagggctggcggttggagggcaggcggttggagggcaggcggttggctttctggtcttagtcaytcccagtctgaagacaaggcagaggcctagtgattcccagattcgatatgtgtcagaatcacccagaaggcttggctgttagaggccagagtgctgcgttccccagagttcccgactaggcctgtctggtgtggggcccaagaatgcatttctgaaacagtccaggtctgccaagagcctccggtgcaggtcagaggctttctgggtccacctctcttagaagcagtttgaaaaaccgtatccctgcctggtatagtgcctcacgcctgtaatcccagcactttgggaggtcgaggtggg

SEQ ID NO: 8148 - DNA, 601 bp, Human
ctgcaccgggcacaggctcttattctgaaagcagacccagtgaaggtctccctgtgccaggcagaggctcttattctgaaagcagacccagtgaaggtctccctgtgccaggcagaggctcttattctgaaagcagaccctgtgaaggtctccctgtaccgggcacaggctcttattctgaaagggtacgcagcagtttctggaaggaaggaaggagggagggagggagggagggaaagaggaaggaaggaaaggagagcgataggcacagaggaaggtagatgaagccccgcgcccccckggcggagcccagccctgttcaccgcgtgctgtgcgggtgcctgtgccaggatcagctggctggacggctatagccccacgcctgcaggccacatacctgggagagtgtgggccttccgagccttctggctcccggccccacagaggaattacggtcccatgtccctcacaaggacccttgcagagggagcagtgcatcggcacagagcaggacacaggggagccgggctgaggctgcgggtcccttgtggccgccaggtgctcacgcgtgcctcggtggggatctggcagccagatttgg

SEQ ID NO: 8149 - DNA, 601 bp, Human
ctgaaagcagacccagtgaaggtctccctgtgccaggcagaggctcttattctgaaagcagacccagtgaaggtctccctgtgccaggcagaggctcttattctgaaagcagaccctgtgaaggtctccctgtaccgggcacaggctcttattctgaaagggtacgcagcagtttctggaaggaaggaaggagggagggagggagggagggaaagaggaaggaaggaaaggagagcgataggcacagaggaaggtagatgaagccccgcgcccccctggcggagcccagccctgttcacckcgtgctgtgcgggtgcctgtgccaggatcagctggctggacggctatagccccacgcctgcaggccacatacctgggagagtgtgggccttccgagccttctggctcccggccccacagaggaattacggtcccatgtccctcacaaggacccttgcagagggagcagtgcatcggcacagagcaggacacaggggagccgggctgaggctgcgggtcccttgtggccgccaggtgctcacgcgtgcctcggtggggatctggcagccagatttggggtgaggatttgatgatgtgggta

SEQ ID NO: 8150 - DNA, 601 bp, Human
cagaggaaggtagatgaagccccgcgcccccctggcggagcccagccctgttcaccgcgtgctgtgcgggtgcctgtgccaggatcagctggctggacggctatagccccacgcctgcaggccacatacctgggagagtgtgggccttccgagccttctggctcccggccccacagaggaattacggtcccatgtccctcacaaggacccttgcagagggagcagtgcatcggcacagagcaggacacaggggagccgggctgaggctgcgggtcccttgtggccgccaggtgctcacgcrtgcctcggtggggatctggcagccagatttggggtgaggatttgatgatgtgggtatccctagctggtcccacagtgacgatgggtgttgcgttgtgagcatgtaaaacggcagtgacgtctgagggtccctggacgtctttcacacccagcctcaaagcggagcctttccaggcagagcagcagctgccgccactggattgacagccccagagcagcgggatcaggccacgcggacgaggaggtgcgaggcctcgggtcggggcctgtgttctgcgggagccgcacccatcatcgctgt

SEQ ID NO: 8151 - DNA, 601 bp, Human
cacagagcaggacacaggggagccgggctgaggctgcgggtcccttgtggccgccaggtgctcacgcgtgcctcggtggggatctggcagccagatttggggtgaggatttgatgatgtgggtatccctagctggtcccacagtgacgatgggtgttgcgttgtgagcatgtaaaacggcagtgacgtctgagggtccctggacgtctttcacacccagcctcaaagcggagcctttccaggcagagcagcagctgccgccactggattgacagccccagagcagcgggatcaggccacgyggacgaggaggtgcgaggcctcgggtcggggcctgtgttctgcgggagccgcacccatcatcgctgtggcggtggcagtggagcagctgctctcgtgtctgagctgctccggcgtctctgtccacagtatagggtcttctgatgcttcctggaggtctcggaggggcttgctgcgtgtagtacccacacagcccacaactggggtgttgtcaagtgttatgacgtaggttgcctgtggagtaaaagttggccgctaagaaatgctctagacaggccgggcacggcggctcacacctgtca

SEQ ID NO: 8152 - DNA, 601 bp, Human
gggatcaggccacgcggacgaggaggtgcgaggcctcgggtcggggcctgtgttctgcgggagccgcacccatcatcgctgtggcggtggcagtggagcagctgctctcgtgtctgagctgctccggcgtctctgtccacagtatagggtcttctgatgcttcctggaggtctcggaggggcttgctgcgtgtagtacccacacagcccacaactggggtgttgtcaagtgttatgacgtaggttgcctgtggagtaaaagttggccgctaagaaatgctctagacaggccgggcacggcrgctcacacctgtcatcccagcactttgggaggccgaggcgggcggatcacgaggtcaggagattgagaccatcctggctaacacggtgaaaccctgtctccaccaaaaatacaaaaaattagctggacatggtggcgggcgcctgtagtcccagctattcgggaggctgaggcaggagaatggcatgaacccgggaggtggagcttgcagtgagctgagatcgcgccactgcactcccgcctgggcgacagagcgagactgtctcaaaaaaaaaaaaaaaaaaatgctccagacacttca

SEQ ID NO: 8153 - DNA, 601 bp, Human
gctaagaaatgctctagacaggccgggcacggcggctcacacctgtcatcccagcactttgggaggccgaggcgggcggatcacgaggtcaggagattgagaccatcctggctaacacggtgaaaccctgtctccaccaaaaatacaaaaaattagctggacatggtggcgggcgcctgtagtcccagctattcgggaggctgaggcaggagaatggcatgaacccgggaggtggagcttgcagtgagctgagatcgcgccactgcactcccgcctgggcgacagagcgagactgtctcaaaaaaaaaaaaaaaaaaatgctccagacacttcagtttgaaaatattggaatttatgtggggaggattagtgtgcatggaaggccaaaaatgtgaatgcatctccgcagtcatctttccaaaagccgccctctgaatcagtgaggaccctcagggtggggaacgtccccttgtgagtgtctgcagattggagtaggcagcagcggagcccgtctctgtagatggactcgcagaggaacttagttctttccctaaaggagtaggaacagctgggcgccgtggctcacgcctgcaatcccagc

SEQ ID NO: 8154 - DNA, 601 bp, Human
ggaggctgaggcaggagaatggcatgaacccgggaggtggagcttgcagtgagctgagatcgcgccactgcactcccgcctgggcgacagagcgagactgtctcaaaaaaaaaaaaaaaaaaatgctccagacacttcagtttgaaaatattggaatttatgtggggaggattagtgtgcatggaaggccaaaaatgtgaatgcatctccgcagtcatctttccaaaagccgccctctgaatcagtgaggaccctcagggtggggaacgtccccttgtgagtgtctgcagattggagtagrcagcagcggagcccgtctctgtagatggactcgcagaggaacttagttctttccctaaaggagtaggaacagctgggcgccgtggctcacgcctgcaatcccagcactttggaagaccagggtgggcagactgcttgtgcccaggagttcaagaccagcctggacaacatggtgaatctctgtgtctacaaaaaatcacaaaagtggctgtggcggcagcacctgtagtcccagccaccaagaggctaaggcagggagatcgtttgagccagggaggttgaggctgcagtgaaccgtgat

SEQ ID NO: 8155 - DNA, 601 bp, Human
aaaaaatcacaaaagtggctgtggcggcagcacctgtagtcccagccaccaagaggctaaggcagggagatcgtttgagccagggaggttgaggctgcagtgaaccgtgatcgccccactgcactccatcctgggagacagggtgagaccctctccacatagtaagtaaatggaggaatagaaacgcaagccggcatacattgtctttgacagcattttgtggataggcaagttctaaccatgggggcaacgtgggatgcagcagggtttggtgtgccgtggggcaggggtaatttgcttrtttctctaagactttgtacagctctataaacagattcccattaggtcgtcctttccttgtgacaggtaatagtggaggtgtcacaaggtaagtggcctgtcttgcctggttttcaggttctacggcttttgtcttgttttttgagaaagggtctgtcactgagactggagtgcagtggcgtgatcacagctcagtgcagccttgaactcgtgggctcaagtgattctcctgcctcagcctcctgagtagccaggactacaggcacgtacaaacatgtccagctaatattttttttctttt

SEQ ID NO: 8156 - DNA, 601 bp, Human
gcagcacctgtagtcccagccaccaagaggctaaggcagggagatcgtttgagccagggaggttgaggctgcagtgaaccgtgatcgccccactgcactccatcctgggagacagggtgagaccctctccacatagtaagtaaatggaggaatagaaacgcaagccggcatacattgtctttgacagcattttgtggataggcaagttctaaccatgggggcaacgtgggatgcagcagggtttggtgtgccgtggggcaggggtaatttgcttgtttctctaagactttgtacagctctrtaaacagattcccattaggtcgtcctttccttgtgacaggtaatagtggaggtgtcacaaggtaagtggcctgtcttgcctggttttcaggttctacggcttttgtcttgttttttgagaaagggtctgtcactgagactggagtgcagtggcgtgatcacagctcagtgcagccttgaactcgtgggctcaagtgattctcctgcctcagcctcctgagtagccaggactacaggcacgtacaaacatgtccagctaatattttttttcttttgtagagatggggtcttaccgtgctgc

SEQ ID NO: 8157 - DNA, 601 bp, Human
gtaagtaaatggaggaatagaaacgcaagccggcatacattgtctttgacagcattttgtggataggcaagttctaaccatgggggcaacgtgggatgcagcagggtttggtgtgccgtggggcaggggtaatttgcttgtttctctaagactttgtacagctctataaacagattcccattaggtcgtcctttccttgtgacaggtaatagtggaggtgtcacaaggtaagtggcctgtcttgcctggttttcaggttctacggcttttgtcttgttttttgagaaagggtctgtcactsagactggagtgcagtggcgtgatcacagctcagtgcagccttgaactcgtgggctcaagtgattctcctgcctcagcctcctgagtagccaggactacaggcacgtacaaacatgtccagctaatattttttttcttttgtagagatggggtcttaccgtgctgctcaggctggtctcaaactcctaggttcaagtgattctctcgcctctgcctccccaaatgctgggactacaggtgtgagccaccgcgcccagccttctccttgtgtttgaactggagaggacagagtgctatacat

SEQ ID NO: 8158 - DNA, 601 bp, Human
agaccagcaggtgcttctggagacaagagcaaagccttttccggcagcccggaacctgggatgagaaacgacaggtggaaggttgtccagagacacctacagcgtggatgctgttccgagtcagcgtaggagaaaggccactggaaaccagagtcacactgcgcgtctgtgcatctctggcctaccgcagtggccccggctgtctgcacattttttgtagacacattagagtcggttgaggccacacctgcggccacagactgcgaccgcgattgcagggaggagcatctgaggtggtcasggggtttgcccagctcacaccaactgcaggtcagttcctgcttcgccttcagtagcctgagtcccttcttctttttctttcacgttactagggcagttgttcgctgacgccttaattctggaacacgttccttgcccagattcttggtggctgcttgttcccttctcatcgttcctgctgtgttttccatgcttggtgtagggggaccctcagagcttggtgtagggggagcctcagagcttggtgtagggggagcctcagagcttggtgtagggggagcctcagaggtggcgtcaggac

SEQ ID NO: 8159 - DNA, 601 bp, Human
gcccagctcacaccaactgcaggtcagttcctgcttcgccttcagtagcctgagtcccttcttctttttctttcacgttactagggcagttgttcgctgacgccttaattctggaacacgttccttgcccagattcttggtggctgcttgttcccttctcatcgttcctgctgtgttttccatgcttggtgtagggggaccctcagagcttggtgtagggggagcctcagagcttggtgtagggggagcctcagagcttggtgtagggggagcctcagaggtggcgtcaggacgtgcctgycccaccggttgccctggtgccctcgtcacgccccgggaccgcgcacacgtggggactgtttccagacgcactttctgcgggcagtctgtgtggcagggctccctgcccagctcctgcagcctcatcaagtctcccactaaggaggtgtcgctcctccaactttgttctttttaaaaatcgcttcagccattctaggtccttggcatttccgcgtgaactgtaggattcctacaccaagcctgctggcgtcttgattgggacggtgttgaatccagagtgtgtggcagagctggcggagcc

SEQ ID NO: 8160 - DNA, 601 bp, Human
cagtagcctgagtcccttcttctttttctttcacgttactagggcagttgttcgctgacgccttaattctggaacacgttccttgcccagattcttggtggctgcttgttcccttctcatcgttcctgctgtgttttccatgcttggtgtagggggaccctcagagcttggtgtagggggagcctcagagcttggtgtagggggagcctcagagcttggtgtagggggagcctcagaggtggcgtcaggacgtgcctgccccaccggttgccctggtgccctcgtcacgccccgggaccgygcacacgtggggactgtttccagacgcactttctgcgggcagtctgtgtggcagggctccctgcccagctcctgcagcctcatcaagtctcccactaaggaggtgtcgctcctccaactttgttctttttaaaaatcgcttcagccattctaggtccttggcatttccgcgtgaactgtaggattcctacaccaagcctgctggcgtcttgattgggacggtgttgaatccagagtgtgtggcagagctggcggagcccctctttctttgatctctgccgatctccttgatttcacgttt

SEQ ID NO: 8161 - DNA, 601 bp, Human
gaggtgtcgctcctccaactttgttctttttaaaaatcgcttcagccattctaggtccttggcatttccgcgtgaactgtaggattcctacaccaagcctgctggcgtcttgattgggacggtgttgaatccagagtgtgtggcagagctggcggagcccctctttctttgatctctgccgatctccttgatttcacgtttgttttattccacagaccaccccctccccatcttctcacctacttcaggttccatttcatggtaggaaattcctgtagtcctcccgggcttgctgaagtgmtgctccaagttacagtccccgggttgtcaggcgtggcgagagccccttgtgctcagagctctcacggaacacagagcaagcctgtctacgagttcagccggtgaggggcaggggctggtgaaggcggcggcgcctctgggtgtgcccaggggcagggtcgcctccaggccccacgcgctaagccgtgactccctgtaacacacccgtgtcgacacaggtcacgtgggcccgaggtgctcatacatcacactccttgtccaggatggtccttcctggcaccatgtggtcctcggtgcaaac

SEQ ID NO: 8162 - DNA, 601 bp, Human
ctacgagttcagccggtgaggggcaggggctggtgaaggcggcggcgcctctgggtgtgcccaggggcagggtcgcctccaggccccacgcgctaagccgtgactccctgtaacacacccgtgtcgacacaggtcacgtgggcccgaggtgctcatacatcacactccttgtccaggatggtccttcctggcaccatgtggtcctcggtgcaaaccagagtttgcagtgctcgctgcacagacccttctgccttattcagcatctttagatcaacagagtcagtgccttcccaagagagcmcgtgtgggcctcatcaggagcatgtgcccaactcgtgtgtgtgttccttctctgccctggaggagaggggtcgccctctcttgtggcccaccccggggctgcagggctgatggctgctccctccccagctccggcacctccagggctctgctgcctttagtcttccttgcgtgccctccacctccctccgagcctctgctgagacctctgcttcagggccgggcgtgttagcacagcccctctgctgttacagggctccatgtggggtctccacgtggcggagtacctcgcgacagaggc

SEQ ID NO: 8163 - DNA, 601 bp, Human
tcggcacatccgtcatctcattgaccatttctaggtgttgggaaccttctggctgtttgaaaccgtattgttgactcccatcatctcgcagtgctgcagaacactaaacttattccttctgtctagctgtcgtttctagttttacgtctttttaaaaattattcctcctgtctgtcatttctagttttatgtccttttaaaaattatttattttttatagagacggggtcttgctatgttgtccaggctggtctcagcctcctggcctcaagggacccgcctgcctcagcctctcttgggrttgcaggcgtggaccactgtgcctggcctacgcctcttgtattctctgggtcatccagtcaacttgagccctggtgagggtgaggctgttgggttgggtgagtcagccgtgttgtgctgccgtaacagaacacccaagatggaagactttagcatgaacagaaacggattggcttgcagttctggaggctggcaagggccttcttcctgtgtgctcacgtggtgatggggtgaaggcatattcacccttttagaatgaactcactcctggaatcatgagcctgtcccttggtgacagcat

SEQ ID NO: 8164 - DNA, 601 bp, Human
ttcagggtattggtgcttgtcagacactggctgtgactcgcatctgggtgcgtgtgcctctctctgtgggggccaccctgccgtcaggcgccaggaaaccgacgtcagggaatgtgggggtctccctgagagggtgccgacctaacacggctcctccgggtcacgtgggtgggctcagcggcctcccgtgcctcccctaggtctggagtctcccctgccctctcgttgggctccaagcctcttcctcagcccagcttcctgctttgtggcagccgtgctttctggaagctgagcagcttcttttttttttttttttttttgagacggaatttctttgtcccccagactggagtgcaatggcacgatctcagttcactgcagcctccgcctcctgggttcaagtgattctcctgcctcagcctcccgagtagttgggactataggcccccaccaccttgcccggctaatgtttttgtatttttagtagagatggtgtttcaccatgctggccagttcgagactggtcttgaactcgtaacctcaggtgatcctctcgcctcagccttccaaagtgctgggattacaggcgtgagccaccgca

SEQ ID NO: 8165 - DNA, 601 bp, Human
gggtctccctgagagggtgccgacctaacacggctcctccgggtcacgtgggtgggctcagcggcctcccgtgcctcccctaggtctggagtctcccctgccctctcgttgggctccaagcctcttcctcagcccagcttcctgctttgtggcagccgtgctttctggaagctgagcagcttcttttttttttttttttttttgagacggaatttctttgtcccccagactggagtgcaatggcacgatctcagttcactgcagcctccgcctcctgggttcaagtgattctcctgcctcmgcctcccgagtagttgggactataggcccccaccaccttgcccggctaatgtttttgtatttttagtagagatggtgtttcaccatgctggccagttcgagactggtcttgaactcgtaacctcaggtgatcctctcgcctcagccttccaaagtgctgggattacaggcgtgagccaccgcacctggcctcttgttcatgttttatgtgtaaattggtcctctgctatttctgttgctcagaggtggaaaggagaagggaacacgataaagtcacacatccacactgttgacaggggtt

SEQ ID NO: 8166 - DNA, 601 bp, Human
taactatacagaaacatccagattaatggttgaccaaaatctgggcactgtggctcagccaggctggcacataacattacccatcgcatgttagttggaagcttggcctttggaattaactcagcctggtcagccgttagcagccagcagtctctgttctgcccacacacctctgtggactgacccaggacacaggtgagcagcatccatgagaaactgtggtgcttctctcctatgggacagatggagccccgctcccttctgtgtggaaatggtccaggagcatcttgtgcgggtggtggggggcgagggcagggcctccgcatgagggagagcagcgagcggcagccactccttcgccgagccagcagggccatctcctgtctgcctcaaccactactggactcagcctttctcccccagcagtgacatcaaaatagcctatttataggacataacaaagatgatgccagctgttaataaaaatgtccgctaatcaggcagttcacttgctgcagttttttggggtcccaagggcccagcccaggctcctgtgcccttggccaccgtgggccagtccctggggtcttgtgggagcctc

SEQ ID NO: 8167 - DNA, 601 bp, Human
gctcccttctgtgtggaaatggtccaggagcatcttgtgcgggtggtggggggcgagggcagggcctccgcatgagggagagcagcgagcggcagccactccttcgccgagccagcagggccatctcctgtctgcctcaaccactactggactcagcctttctcccccagcagtgacatcaaaatagcctatttataggacataacaaagatgatgccagctgttaataaaaatgtccgctaatcaggcagttcacttgctgcagttttttggggtcccaagggcccagcccaggctcctrtgcccttggccaccgtgggccagtccctggggtcttgtgggagcctccgcgggcctgggagtggcaggacccttagagggcgagagttcacatgagagcgtggggttctgactcgcgagggttcacgtgagagcgtggggttctgagtcgcgagggttcacgtgagagcgtggggttctgactccctcgtgtcatttcagccgcggcgagtcctttgcacatgttggcaacacacgcatccgcatcggcctccctgcccacaaagcgccacaacggtgaccagccggagcagccggagct

SEQ ID NO: 8168 - DNA, 601 bp, Human; identical to SEQ ID NO: 1327

SEQ ID NO: 8169 - DNA, 601 bp, Human; identical to SEQ ID NO: 1328

SEQ ID NO: 8170 - DNA, 601 bp, Human; identical to SEQ ID NO: 1329

SEQ ID NO: 8171 - DNA, 601 bp, Human; identical to SEQ ID NO: 1330

SEQ ID NO: 8172 - DNA, 601 bp, Human; identical to SEQ ID NO: 1331

SEQ ID NO: 8173 - DNA, 601 bp, Human; identical to SEQ ID NO: 1332

SEQ ID NO: 8174 - DNA, 601 bp, Human; identical to SEQ ID NO: 1333

SEQ ID NO: 8175 - DNA, 601 bp, Human; identical to SEQ ID NO: 1334

SEQ ID NO: 8176 - DNA, 601 bp, Human; identical to SEQ ID NO: 1335

SEQ ID NO: 8177 - DNA, 601 bp, Human; identical to SEQ ID NO: 1336

SEQ ID NO: 8178 - DNA, 601 bp, Human; identical to SEQ ID NO: 1337

SEQ ID NO: 8179 - DNA, 601 bp, Human; identical to SEQ ID NO: 1338

SEQ ID NO: 8180 - DNA, 601 bp, Human; identical to SEQ ID NO: 1339

SEQ ID NO: 8181 - DNA, 601 bp, Human; identical to SEQ ID NO: 1340

SEQ ID NO: 8182 - DNA, 601 bp, Human; identical to SEQ ID NO: 1341

SEQ ID NO: 8183 - DNA, 601 bp, Human; identical to SEQ ID NO: 1342

SEQ ID NO: 8184 - DNA, 601 bp, Human; identical to SEQ ID NO: 1343

SEQ ID NO: 8185 - DNA, 601 bp, Human; identical to SEQ ID NO: 1344

SEQ ID NO: 8186 - DNA, 601 bp, Human; identical to SEQ ID NO: 1345

SEQ ID NO: 8187 - DNA, 601 bp, Human; identical to SEQ ID NO: 1346

SEQ ID NO: 8188 - DNA, 601 bp, Human; identical to SEQ ID NO: 1347

SEQ ID NO: 8189 - DNA, 601 bp, Human; identical to SEQ ID NO: 1348

SEQ ID NO: 8190 - DNA, 601 bp, Human; identical to SEQ ID NO: 1556

SEQ ID NO: 8191 - DNA, 601 bp, Human; identical to SEQ ID NO: 1557

SEQ ID NO: 8192 - DNA, 601 bp, Human; identical to SEQ ID NO: 1558

SEQ ID NO: 8193 - DNA, 601 bp, Human; identical to SEQ ID NO: 1559

SEQ ID NO: 8194 - DNA, 601 bp, Human; identical to SEQ ID NO: 1560

SEQ ID NO: 8195 - DNA, 601 bp, Human; identical to SEQ ID NO: 1561

SEQ ID NO: 8196 - DNA, 601 bp, Human; identical to SEQ ID NO: 1562

SEQ ID NO: 8197 - DNA, 601 bp, Human; identical to SEQ ID NO: 1563

SEQ ID NO: 8198 - DNA, 601 bp, Human; identical to SEQ ID NO: 1564

SEQ ID NO: 8199 - DNA, 601 bp, Human; identical to SEQ ID NO: 1565

SEQ ID NO: 8200 - DNA, 601 bp, Human; identical to SEQ ID NO: 1566

SEQ ID NO: 8201 - DNA, 601 bp, Human; identical to SEQ ID NO: 1567

SEQ ID NO: 8202 - DNA, 601 bp, Human
ccatgcttgagcacaaagggcttaatggtccattccagacatccctacccttgactctaactgccagcatcttctcaaagggctgtagtcaagaaagatcactgagtaatggggtggggggataaatgtgacataggagatagccaaacaatgaggctgacatgagacttagggggtgaggctgggaggtgtagtagccaggggctcaggggacctggatcctctccctggacctgcccttatcagttgagagtcattaagcttcaaaatgagaagctaggggtcaccactaatcctaagrcccctgggcattccccctgaaattagagttgccaagctctcctgcctttttctgtgatggttagaaacagtggtgctttttccctgctgctgagtgtgcccagccacttggtcaaatgggcatctggaggaccccaataagcttctctttcttcactgcccaagctttggctcactgcccattccctggagggcacagggctaagctaggccctggatggggactcaaaagccttgagatcccatccggagctggaggagcccacagttgggccagagaaacagcatgtgatgaagggtt

SEQ ID NO: 8203 - DNA, 601 bp, Human
agccaaacaatgaggctgacatgagacttagggggtgaggctgggaggtgtagtagccaggggctcaggggacctggatcctctccctggacctgcccttatcagttgagagtcattaagcttcaaaatgagaagctaggggtcaccactaatcctaaggcccctgggcattccccctgaaattagagttgccaagctctcctgcctttttctgtgatggttagaaacagtggtgctttttccctgctgctgagtgtgcccagccacttggtcaaatgggcatctggaggaccccaataarcttctctttcttcactgcccaagctttggctcactgcccattccctggagggcacagggctaagctaggccctggatggggactcaaaagccttgagatcccatccggagctggaggagcccacagttgggccagagaaacagcatgtgatgaagggttatgacgtaaggtggtaggtggcattagagaaatatggtggacggaagaataatgaaagacagaaaggagggagaaggtttaaattcctagcaccaggggaattctaagcttgaggaaaacaaggtgcatatggaatacatt

SEQ ID NO: 8204 - DNA, 601 bp, Human
aagcttcaaaatgagaagctaggggtcaccactaatcctaaggcccctgggcattccccctgaaattagagttgccaagctctcctgcctttttctgtgatggttagaaacagtggtgctttttccctgctgctgagtgtgcccagccacttggtcaaatgggcatctggaggaccccaataagcttctctttcttcactgcccaagctttggctcactgcccattccctggagggcacagggctaagctaggccctggatggggactcaaaagccttgagatcccatccggagctggagragcccacagttgggccagagaaacagcatgtgatgaagggttatgacgtaaggtggtaggtggcattagagaaatatggtggacggaagaataatgaaagacagaaaggagggagaaggtttaaattcctagcaccaggggaattctaagcttgaggaaaacaaggtgcatatggaatacattaataaaagataacttataaggcaatatgccacaggcataggtgaatgcaaggtagaatgaatgatataaagtaaaataatcaaggatttattcttgaagttggggacatatggattg

SEQ ID NO: 8205 - DNA, 601 bp, Human
aagggttatgacgtaaggtggtaggtggcattagagaaatatggtggacggaagaataatgaaagacagaaaggagggagaaggtttaaattcctagcaccaggggaattctaagcttgaggaaaacaaggtgcatatggaatacattaataaaagataacttataaggcaatatgccacaggcataggtgaatgcaaggtagaatgaatgatataaagtaaaataatcaaggatttattcttgaagttggggacatatggattggtgaagaatagcaggcaagtgcagttccaataaagygaatagcctgaatatttcttttttcttccttctttctgcctttcctccctccctcctttcctcctttccttcttcctgactctaacctaggctgatcacacagtattcttaggttatagcaaaagaaaaccctgcttcttggccatgtccatttccttccttagctccatttaccctaacacctacccattcacccactcatccatcttttcatctacttattcttcctacatcctgtccattcctccactcatccatctatttatccacctacccatccactcacttccaaatagttta

SEQ ID NO: 8206 - DNA, 601 bp, Human
ctgcctccaatgttaatcctacccagaacatgcctcagattcccacagttcttcctaccaccactaaggccctgagcccactgtatgccagcccaagaaccatgacccagccttcacccaagtcaactgctgatgtctccactcctggcccacagtcaacaataaaaatgtgacaaatgtcatcaactatgatttcccagcctctgagccccgggtttggacatcaagctctttgttccccagttcgtgtgctgagaggatgtgggagtgagggaaaggggaaggtggggcaggagcagacttgagtcacattagtctgggtagaaatgtccaggggaagaaggaggtggtgatggagaataggggaggctctcagccaggctgtcattctccctagttcaccttccttgttttcttgcaacctgagtattaaggagagggaaatggcatcctccccaaattccaatggagctcatccaaccccaggggcctgatgagtagtgggaacgcactctgaatgagggaccctggatctagtatctacctgactaactgactgtgactttgggtgagtcaggaaccctctctggctttagcttcc

SEQ ID NO: 8207 - DNA, 601 bp, Human
agagggaaatggcatcctccccaaattccaatggagctcatccaaccccaggggcctgatgagtagtgggaacgcactctgaatgagggaccctggatctagtatctacctgactaactgactgtgactttgggtgagtcaggaaccctctctggctttagcttccttgtcaattcagtaggcatgctagaaacccagagctggaagacattgttcacccaacagctctcagcaggagccacatgttagggctaaatgcaatattggtttttgccttgtttggttagttttaaaaaaaaaatactgatgtgtgtgttctcatacacagaccaatagaatcagaatttctggaaatgaagcccatctcagtatttttttataaatacttcagaaagaaactcagagaggaaaggacaaacaggctgaggaatgagaaagaataaaactctttcttttgaaataaaaaaaaaatttatgcgatttttttccctttaagaggaaaatctgctttaattaaatggaaacaatgatccaagctacttaagtataaaagcacattgtactataaaatgtttaatctgtattaataagaagctaaatt

SEQ ID NO: 8208 - DNA, 601 bp, Human
tctgaatgagggaccctggatctagtatctacctgactaactgactgtgactttgggtgagtcaggaaccctctctggctttagcttccttgtcaattcagtaggcatgctagaaacccagagctggaagacattgttcacccaacagctctcagcaggagccacatgttagggctaaatgcaatattggtttttgccttgtttggttagttttaaaaaaaaaatactgatgtgtgtgttctcatacacagaccaatagaatcagaatttctggaaatgaagcccatctcagtatttttttataaatacttcagaaagaaactcagagaggaaaggacaaacaggctgaggaatgagaaagaataaaactctttcttttgaaataaaaaaaaaatttatgcgatttttttccctttaagaggaaaatctgctttaattaaatggaaacaatgatccaagctacttaagtataaaagcacattgtactataaaatgtttaatctgtattaataagaagctaaatttataacaaggagctgaatgctttttagttgactatgttgaggcaaaagtctataaaacagcatttcctacaatggtg

SEQ ID NO: 8209 - DNA, 601 bp, Human
caattcagtaggcatgctagaaacccagagctggaagacattgttcacccaacagctctcagcaggagccacatgttagggctaaatgcaatattggtttttgccttgtttggttagttttaaaaaaaaaatactgatgtgtgtgttctcatacacagaccaatagaatcagaatttctggaaatgaagcccatctcagtatttttttataaatacttcagaaagaaactcagagaggaaaggacaaacaggctgaggaatgagaaagaataaaactctttcttttgaaataaaaaaaaaatttatgcgatttttttccctttaagaggaaaatctgctttaattaaatggaaacaatgatccaagctacttaagtataaaagcacattgtactataaaatgtttaatctgtattaataagaagctaaatttataacaaggagctgaatgctttttagttgactatgttgaggcaaaagtctataaaacagcatttcctacaatggtggaatgttctctctccctgtccaacatgggtagccactagccatgcgtggtaattgagcatctgacctgagacaaatgagagtgaaggactgaa

SEQ ID NO: 8210 - DNA, 601 bp, Human
cacactggcagacacatgaactacagctaatttgaagcatggcagaatgcctgcaaccctcctagaacataaaaggatggaggcttgtgagaaccatggcccagtaacttctctgtctcccctgaaagacagttcctcatgccctcctgagttctgatgaggccagaggctctgtcccagacctcagaatagggctgcaggttatgaaaccacttatctgcctctagagtagattcctcagcagtggaatgtcccacaactcatattgcagttgtctggccccttttgttttggggtgtgkgacaagagccatgaggagctggcacctttgcctaatctttcccttgttgtctgtgtaaataataaattgactgaaagtaaaagtggctcattgctgacattgtgccactgcactccagcctggcaacagagcaagactccttgaaaaaaaaaaaaagcggctaattgcattattagcagtcaaatcagtcaggacttggctttggcgcagccttgtctcacatgagcttaacaagtgacaaatgacagactgagacaagatatttgcaatttctaacatagaataatatctagttttttt

SEQ ID NO: 8211 - DNA, 601 bp, Human
atgaggccagaggctctgtcccagacctcagaatagggctgcaggttatgaaaccacttatctgcctctagagtagattcctcagcagtggaatgtcccacaactcatattgcagttgtctggccccttttgttttggggtgtgggacaagagccatgaggagctggcacctttgcctaatctttcccttgttgtctgtgtaaataataaattgactgaaagtaaaagtggctcattgctgacattgtgccactgcactccagcctggcaacagagcaagactccttgaaaaaaaaaaaaagcggctaattgcattattagcagtcaaatcagtcaggacttggctttggcgcagccttgtctcacatgagcttaacaagtgacaaatgacagactgagacaagatatttgcaatttctaacatagaataatatctagttttttttccaagatggctgcctggaagcattttaatcacacctcatccacttagaagaaccaaatagtgtgtagacaatcacactttgaatacattatccaagagggaacttgagagttcaacagaaaagcaaaagaaaagtccaaaatcaaggaaatagaa

SEQ ID NO: 8212 - DNA, 601 bp, Human
agcctggcaacagagcaagactccttgaaaaaaaaaaaaagcggctaattgcattattagcagtcaaatcagtcaggacttggctttggcgcagccttgtctcacatgagcttaacaagtgacaaatgacagactgagacaagatatttgcaatttctaacatagaataatatctagttttttttccaagatggctgcctggaagcattttaatcacacctcatccacttagaagaaccaaatagtgtgtagacaatcacactttgaatacattatccaagagggaacttgagagttcaayagaaaagcaaaagaaaagtccaaaatcaaggaaatagaaagaaaacaggaagcttgtgtagttgggaccagctgggaaccagaacagaccctcccaaatgggagagagtgagtgagagtctttctgtgatccactttcccactggggaatcatacaatccaggacatgggagtgcaacttgactctccaatccctgaatctaacttacagagcagctgggagactgtgagaagaaacttccccatggaggtagcatgccctgggtttcacacccttcctgagacctaagaaactgccatt

SEQ ID NO: 8213 - DNA, 601 bp, Human
tgtagcaggacctcagtgcaacaatgcttgcccctcactgaagcattttgccaggggcctgagtactgctccatccccctgtagcagctggtgcatgcactcgccattggagggtctgagtatcagctttcctggccaagttgtgcccagcttcatcctacctcccaccccgagacagagtgcagaatctaagctccgaggggtttcacaacccaatccaccacctgggacacccacacacttccccctatgcaggacagaagtcaggcaaaaacaccctaccactcccacctcagctggyttctaccttcaagctccacctactgacctgaaggccggtccacacagcccattgcaaccactgccaacacaaaaacacagcactcaggaccaagaagaagaactcgccactactgctattgccatcacccatgccactttggctgtccaggagttgagagcccactcacctgccaagtacaccactactgcaactgaccttagaaaaagccaccccagatgcccaagaatcagcctgcctgggcccatcaatacaagtgccagtgtacgctgccctaggtcacaagaatagacatgctta

SEQ ID NO: 8214 - DNA, 601 bp, Human
ctggtgcatgcactcgccattggagggtctgagtatcagctttcctggccaagttgtgcccagcttcatcctacctcccaccccgagacagagtgcagaatctaagctccgaggggtttcacaacccaatccaccacctgggacacccacacacttccccctatgcaggacagaagtcaggcaaaaacaccctaccactcccacctcagctggcttctaccttcaagctccacctactgacctgaaggccggtccacacagcccattgcaaccactgccaacacaaaaacacagcactcargaccaagaagaagaactcgccactactgctattgccatcacccatgccactttggctgtccaggagttgagagcccactcacctgccaagtacaccactactgcaactgaccttagaaaaagccaccccagatgcccaagaatcagcctgcctgggcccatcaatacaagtgccagtgtacgctgccctaggtcacaagaatagacatgcttagcccaccactgctactactgaaacctaaaggcccatctggcatttcagtccccagcacaacttcaccatagtctccaccaataacta

SEQ ID NO: 8215 - DNA, 601 bp, Human
ctggccaagttgtgcccagcttcatcctacctcccaccccgagacagagtgcagaatctaagctccgaggggtttcacaacccaatccaccacctgggacacccacacacttccccctatgcaggacagaagtcaggcaaaaacaccctaccactcccacctcagctggcttctaccttcaagctccacctactgacctgaaggccggtccacacagcccattgcaaccactgccaacacaaaaacacagcactcaggaccaagaagaagaactcgccactactgctattgccatcacccrtgccactttggctgtccaggagttgagagcccactcacctgccaagtacaccactactgcaactgaccttagaaaaagccaccccagatgcccaagaatcagcctgcctgggcccatcaatacaagtgccagtgtacgctgccctaggtcacaagaatagacatgcttagcccaccactgctactactgaaacctaaaggcccatctggcatttcagtccccagcacaacttcaccatagtctccaccaataactacatccaaacacaccaaggaaaccacagatactaccaacactatt

SEQ ID NO: 8216 - DNA, 601 bp, Human
caaggaaaccacagatactaccaacactatttatagccaaataactcatacagagtcttcaccactgcacacatccagaagcaaagcttaagggtactaccaaaacaagattatagtcacatcttcaagaaaaaagcctccccctcccctcatgagagtaaattcaaacacagaagaaatgactattacaccagatgtgcagaaattaatgtaaagaaatgtggcaggccaattctccctgacaatcacatagacagacctgcatagcactccagttacacagacagatttccacagcacygccttaacattgagcaaatagttaaacctaaggaaatcagtgcccagacatcaaagctaggaatgaaacatatggtcagtaggaccttacctgggcttctccttaacctggagcaagccaaatagtagaggcagtcttacattcctagtgccagggcccaacttgggttgacaaaatctgagatgacccgaggtaacaggggcagctgtttgaatagattcattgcagagtctaaagaaaatctctggaccaaactataaaggagataagatagaaataatcactccggtaccgcagtag

SEQ ID NO: 8217 - DNA, 601 bp, Human
aggggatgaatgggaactgctgcagatatgagcacaggagctgctgccaacagtgtgggcagatggggagggttgaagcctgaaagccatgcttgctttctcagtggggaagctcatggcttggggcaagttctgaatggagcactgagggggcaagactggccttgccaactgcatgagagctggatgaggcctctcgctaccagctatcccccacttccctgatgaactataagacacagcagaagcagtcaaaatcccctctggaacataataccattggcctgagaatcaccccacyatccttcacagtggctatggcaagctctgcccaaggagagtctgaacccagacccacttaactctgccacccacctgatggtatttctctatgttctctggtagctgactaaaaagaaactcttgggagctttatggccccacccaacacctgagaaactaaaatacttatcttgtccaactcaggacatacttggatccccctactattaccacagatggtgctctcttgaaaacccaacctcttgtttggaggccaaccaacacaagccatcacagcaactcatgacagaacaatcct

SEQ ID NO: 8218 - DNA, 601 bp, Human
gaactataagacacagcagaagcagtcaaaatcccctctggaacataataccattggcctgagaatcaccccaccatccttcacagtggctatggcaagctctgcccaaggagagtctgaacccagacccacttaactctgccacccacctgatggtatttctctatgttctctggtagctgactaaaaagaaactcttgggagctttatggccccacccaacacctgagaaactaaaatacttatcttgtccaactcaggacatacttggatccccctactattaccacagatggtgctstcttgaaaacccaacctcttgtttggaggccaaccaacacaagccatcacagcaactcatgacagaacaatcctgatcccaagaaagagaagacaacagcaattccactgcttgcaatatcctggctggccaaaggtcctgagtgtgtccacgtgatatggttttgctgtgtccccacccaaatctcatcttgaattgtagctctcataattcccatgtctcatgggagggactcagtggcaggtaattgaattatggtggcaggtctttcccgtgctgttctcatgatagtgaataact

SEQ ID NO: 8219 - DNA, 601 bp, Human
aaggttgattattaagctcctaagggagataacacggaaaggtgaaaaacaacttaaataatctttttttaaaatacagaatatggatgaaaaattctccagagaaatagttatcataaagtaaaaacaatcacaacttctggaaatgacatacacacttagagaaatacaaaatgcaatggaaaatttcaacaatagactagaacaagtagaagaaagaacttcagagcttgaagacaaggcttttgaattaatgcagataaagacatagaaaaatgaatttttaaaaaaagaacaaatmctccaataaatttgggattaagttaaatagccaaacctaagaataatttctgttcctgaggaaaaagagaaatctaaaagttgggaaaacttacttgaggcattaattgaggaaaatttccctggccttgctagagatctagacatccaaatacaagaagctcaaaagacacctgggaaattcatctccaaaagatcatcacctaggcacatagtcatcggattatctaaagtcaagatgaaggaagaatcttaagagctgtaagacaaaagcatcaggtaacctataaaggaaaaccca

SEQ ID NO: 8220 - DNA, 601 bp, Human
aacaaaacctcaaaatacaccaatgttacatacactgcaggtttatagcagcacaattcacaattgcaaaaatatggaaccagcctaattgcccatcaaccaacaaatggataaagaaaatgtggtatatatacacaatggaatactattcagccataaaaaggaatgaaataaggtcatttgcagactcacctggatgaattcggagaccattattctaactgaagtaactcaggaatggaaaaccaaatgttgtatattctcacttataagttggagctaagctatgaggacacaaagrcataaggatgatataatggactttgggggctcagggggaaggatgaaagggtgtgaaggataaaagactatacattggatacagtatacactgctcagatgacaggtgcaccaaaatctcagaaattaccactaaagaacgtatccatgtaaccaaaaatcacctgttcccccaaaactactgaaatttaatttaaatttaaaacacgaaacaaaatattgattttaaggaaactcaagatgcaagagatgcaaaagaaatcaaaataaatgcaaagcactcagaaaattaattcaggat

SEQ ID NO: 8221 - DNA, 601 bp, Human
tgagagaaaaagaaaaaaacaaagacttgatagaacaactagaaaataattagcaatatgagagaaacaaaaccccacatatcaatattaactttaaatgtaaatgcattaaatgctccacttaaatgatatagattggctgaattaatttttttaaacatgattcgactatatgctgcttacaagaaactcacattatctataaagacatatacagactgaaagcaaagtgtggaaaaagatattccatgcaaatggaaaccaaaagtgatcaggagtagctatacttatgtagtataawacagactttaaatgaaaaacaacataaaaagacaaataaggttattatatactgataaaaggattgattcagcaagaggataaaacaattctgaatatatatgtacccaacactggagcacctagattcataaaacaaataatattagacctaaagagatagacagcaatacaataataatgaaggccttcaacaccccactcacggtattaaacagtttatctacaaaatgatctaaaatcaacaaagaaacattggacataattggacgttagaacaaatcaacagacatctagagaa

SEQ ID NO: 8222 - DNA, 601 bp, Human
gaaaaagatattccatgcaaatggaaaccaaaagtgatcaggagtagctatacttatgtagtataaaacagactttaaatgaaaaacaacataaaaagacaaataaggttattatatactgataaaaggattgattcagcaagaggataaaacaattctgaatatatatgtacccaacactggagcacctagattcataaaacaaataatattagacctaaagagatagacagcaatacaataataatgaaggccttcaacaccccactcacggtattaaacagtttatctacaaaatgayctaaaatcaacaaagaaacattggacataattggacgttagaacaaatcaacagacatctagagaacattctacccaacaattgcagaatatacattctttcagcagcccttggaaacttctccaagatagaccatatagtaggctacaaaataagtctcaacaaatttttaaaaatagaaatcatatgaaatatcttctatgatcatcaaaatttattccacatcacagtggaataagttttttaaaatagaaattatataaagtatcttctaggattgcagtggaataaaactagaaa

SEQ ID NO: 8223 - DNA, 601 bp, Human
gattgattcagcaagaggataaaacaattctgaatatatatgtacccaacactggagcacctagattcataaaacaaataatattagacctaaagagatagacagcaatacaataataatgaaggccttcaacaccccactcacggtattaaacagtttatctacaaaatgatctaaaatcaacaaagaaacattggacataattggacgttagaacaaatcaacagacatctagagaacattctacccaacaattgcagaatatacattctttcagcagcccttggaaacttctccaagrtagaccatatagtaggctacaaaataagtctcaacaaatttttaaaaatagaaatcatatgaaatatcttctatgatcatcaaaatttattccacatcacagtggaataagttttttaaaatagaaattatataaagtatcttctaggattgcagtggaataaaactagaaatcaataccaagaagaactttggaaactatacaaatacatggaaattaacacactcccaaaaaaaatcactggaccaatgaagaaattaagttagaaatttaaaaacttttagaaacaagtgaaacctg

SEQ ID NO: 8224 - DNA, 601 bp, Human
aacagtttatctacaaaatgatctaaaatcaacaaagaaacattggacataattggacgttagaacaaatcaacagacatctagagaacattctacccaacaattgcagaatatacattctttcagcagcccttggaaacttctccaagatagaccatatagtaggctacaaaataagtctcaacaaatttttaaaaatagaaatcatatgaaatatcttctatgatcatcaaaatttattccacatcacagtggaataagttttttaaaatagaaattatataaagtatcttctaggatygcagtggaataaaactagaaatcaataccaagaagaactttggaaactatacaaatacatggaaattaacacactcccaaaaaaaatcactggaccaatgaagaaattaagttagaaatttaaaaacttttagaaacaagtgaaacctgttaggtttctacctaacagagatcttgccattgcactccagcctgggcaaaaagagcgaaactccatctcaggaaaaaaaaaaaaaaaaaaaaaaaaagaataaaagaaaaaataagaaaagctcaggaccggatagattcatagctgaat

SEQ ID NO: 8225 - DNA, 601 bp, Human
tgatcatcaaaatttattccacatcacagtggaataagttttttaaaatagaaattatataaagtatcttctaggattgcagtggaataaaactagaaatcaataccaagaagaactttggaaactatacaaatacatggaaattaacacactcccaaaaaaaatcactggaccaatgaagaaattaagttagaaatttaaaaacttttagaaacaagtgaaacctgttaggtttctacctaacagagatcttgccattgcactccagcctgggcaaaaagagcgaaactccatctcaggraaaaaaaaaaaaaaaaaaaaaaaagaataaaagaaaaaataagaaaagctcaggaccggatagattcatagctgaattctactaatcctcctcaaaaagacatcttccaaaaaaatcaatgaggagagaattcttcataactcattctacaaggccaatagatccctgataccaaaaccagaaaaggacacaacaaagaaaagaagtctacatactaatattcctgataaacatagacacaaaatttctcaacaaaacactagcaaacaaaaaccaacagtacatcaaaaaaaagtacac

SEQ ID NO: 8226 - DNA, 601 bp, Human
tatacattgcagtaaaaaactatatgcccaagaaactcataaacagatgtttgatcgtgttagttagagaaatactaattttaaaacatggaactgtcactttgaactcatctgaatggtgagcacatggaaggtggatgacactaggagttggtgagagtggaggaaagggggatccttgagccctgctggggggaatgcaacatgacccaacattctggagaacaatctggagcctctgtggcataaatatgtggctatcccatgctcaatgttccatccctgacttatgctctgttaygcatactattttttacgtcctgtttagaaaatatttgacttctccaaggtcattttttctacattttcttccagaaactatattgttttcaccttttatatttaggtctatgatgcattttcaattaatttcatgtgcagtgtgaaagagttaaaaacctattttgttttctgggtgggtatccaactgatcattaccctttgatagaaacaacatcttttccacactaaattgcagaggccctttagtggcagtcaagtgactgtctatgtgtgggtatgttcctaaaccctctatttt

SEQ ID NO: 8227 - DNA, 601 bp, Human
aaaagcacacaaaatcaattctatatattttcaagaatctacatgcatgcaaatagacatggaaaatatgaaatatgattattaagaagatgcctatgagggaagggtaggcagtgcagctcaggatgaaggtagtaaagattaaaaaaaacacacacattaagctaggagtggtagttcatggctataatcttagcactttgggaggccaaggagggaggatcacttgagcccaggagttcaagaccagcctgggtaacatagcaagactccatctctatacataaaaatacacattaaraaaacacatgaaaccaaatgagtggtaaagtgtttcctttaaagtgggccatgaaataaggagtctgtcaactcagtttggttacatgaagatcttttgtgaaaaaaataagacaaaagctaaagctaaaacaaaaacacagcatgtttgcatttttgtttgcttacagttgaccttgccatctttcagggcgtaggttttcctttataacatgaatgcaaggattgagttccagcctgggagaagaactgacttatccgaaagtgcccagtgtgcagtggtgggagaggatgggattcc

SEQ ID NO: 8228 - DNA, 601 bp, Human
caaaaacacagcatgtttgcatttttgtttgcttacagttgaccttgccatctttcagggcgtaggttttcctttataacatgaatgcaaggattgagttccagcctgggagaagaactgacttatccgaaagtgcccagtgtgcagtggtgggagaggatgggattccacatccagccttctgatgccaaatgtcatgctcttttccctgcaaattcaagcgggggaaatgattgggtcagggagcccatacaggagataggcaaggacgtttcacttggcatcctttatggtccctctscaacatcagaaattcccttagacaagaacaatctgtacgggatgctgcttctctggctagattagcctcaagttttctccagttcctggagagaaggaatacgaagctgctatcaaaatggcactgcctgttatttatggttcaatgaagataattatgtttaagcgtatccttattaaacttgatacagttctcatttaacagtatgcgctcagtctttctcaaccatttctcttgtcttttttaagacttaaattaaagaactgggcagaactccaatgatggattcataccagaagg

SEQ ID NO: 8229 - DNA, 601 bp, Human
gtcatgctcttttccctgcaaattcaagcgggggaaatgattgggtcagggagcccatacaggagataggcaaggacgtttcacttggcatcctttatggtccctctgcaacatcagaaattcccttagacaagaacaatctgtacgggatgctgcttctctggctagattagcctcaagttttctccagttcctggagagaaggaatacgaagctgctatcaaaatggcactgcctgttatttatggttcaatgaagataattatgtttaagcgtatccttattaaacttgatacagttstcatttaacagtatgcgctcagtctttctcaaccatttctcttgtcttttttaagacttaaattaaagaactgggcagaactccaatgatggattcataccagaaggaccaagccatccactggtgcctgaattgggccaactttgctacatgtgaaatataggcctttatttccctgaactcaataaagatcaacaaacccaaaaggttggagccactgaatgtcacagaggggaagccccactgccaggggtttactgaggcctagaaaagggtgaggcacttccccaaggtcactaa

SEQ ID NO: 8230 - DNA, 601 bp, Human
tgcgctcagtctttctcaaccatttctcttgtcttttttaagacttaaattaaagaactgggcagaactccaatgatggattcataccagaaggaccaagccatccactggtgcctgaattgggccaactttgctacatgtgaaatataggcctttatttccctgaactcaataaagatcaacaaacccaaaaggttggagccactgaatgtcacagaggggaagccccactgccaggggtttactgaggcctagaaaagggtgaggcacttccccaaggtcactaagtatgatcaaggcwgagagggaccaagaatccacaatcttctattgccctgtgatggctgcccttacctttgcaaaggactgaagttttagtatttatgtaacaaagaggcaataagaccaaattaataaaatgctcctgagtcaggagcagtgggtgatggacctgcttgaccaattgcatcattgatttgtaatcagcctgtcagtgaccgggtatccttggatgtttctcaagaaccgggaagttattttattctattacatgggttcagtagattccaaccatcctgcccatggctctgtccctttgctt

SEQ ID NO: 8231 - DNA, 601 bp, Human
cagaaggaccaagccatccactggtgcctgaattgggccaactttgctacatgtgaaatataggcctttatttccctgaactcaataaagatcaacaaacccaaaaggttggagccactgaatgtcacagaggggaagccccactgccaggggtttactgaggcctagaaaagggtgaggcacttccccaaggtcactaagtatgatcaaggcagagagggaccaagaatccacaatcttctattgccctgtgatggctgcccttacctttgcaaaggactgaagttttagtatttatgtmacaaagaggcaataagaccaaattaataaaatgctcctgagtcaggagcagtgggtgatggacctgcttgaccaattgcatcattgatttgtaatcagcctgtcagtgaccgggtatccttggatgtttctcaagaaccgggaagttattttattctattacatgggttcagtagattccaaccatcctgcccatggctctgtccctttgcttggtcaactgtttatttgcagatgctatgaagtctgacttcagccccagcctgtcctgatattcacatattcagattagcatatattc

SEQ ID NO: 8232 - DNA, 601 bp, Human
ccttacctttgcaaaggactgaagttttagtatttatgtaacaaagaggcaataagaccaaattaataaaatgctcctgagtcaggagcagtgggtgatggacctgcttgaccaattgcatcattgatttgtaatcagcctgtcagtgaccgggtatccttggatgtttctcaagaaccgggaagttattttattctattacatgggttcagtagattccaaccatcctgcccatggctctgtccctttgcttggtcaactgtttatttgcagatgctatgaagtctgacttcagccccakcctgtcctgatattcacatattcagattagcatatattcaaatagcagaagagcaatgtcctctgctaattaatggaggcctctcaaattcactagcttgaaaagagttttatagaaaaacttgaggcaaaagcactgagctccaccatcccagttccacctccccatgtaggcaggaaggcttgctaacaaaggaggagggggaattggcagtgtttccaccaatgagaagcaaccgaaggtcaccaaaatgtccttcattttcctccctaataactgtgcctcatctactgctattga

SEQ ID NO: 8233 - DNA, 601 bp, Human
ctgggttcaagtgatcctcccatctcagcccccaccacatagctgggactacaggcgtgtgccaccatgtccagctaactttttgttctttctagaaacagggatctcactatgttgcccagactggtctcgaactcctgggctcaagccatcctctcacctcagcctcccaaagtgttgggattacaggtgcgagccatagcacttggcctcacacagctctttgtattagctcctggtgtccccaagacagatgctcttcccattcttctctgttttctcccaaatgggatggatattmccatttggtcccagagggcagtcaacctgaacagttgtagctggcactagtctctacctcctcttcaccctaaatatcacggatcaccctacacctggttccatcatcatcatctcccatcataacatttattaagcacttattaggccctaaatactgagccaagggctttccatacatccactgtttaattcttaagacaaccctctgatacctgtgagtcggttccatttacaatgaggaaactgagcctaatagaggttagaaaccttactcaaggtcacatacatagagtgtggc

SEQ ID NO: 8234 - DNA, 601 bp, Human
ccccaccacatagctgggactacaggcgtgtgccaccatgtccagctaactttttgttctttctagaaacagggatctcactatgttgcccagactggtctcgaactcctgggctcaagccatcctctcacctcagcctcccaaagtgttgggattacaggtgcgagccatagcacttggcctcacacagctctttgtattagctcctggtgtccccaagacagatgctcttcccattcttctctgttttctcccaaatgggatggatattcccatttggtcccagagggcagtcaacctraacagttgtagctggcactagtctctacctcctcttcaccctaaatatcacggatcaccctacacctggttccatcatcatcatctcccatcataacatttattaagcacttattaggccctaaatactgagccaagggctttccatacatccactgtttaattcttaagacaaccctctgatacctgtgagtcggttccatttacaatgaggaaactgagcctaatagaggttagaaaccttactcaaggtcacatacatagagtgtggctgagacaggatttgccccagccctgtctg

SEQ ID NO: 8235 - DNA, 601 bp, Human
ctttacatctcccaggatatcagcacagtgctgggggattgctctgctgaatccacctaattctctcaacttcaagatgcagtagagggacctccagcttctgtttcatcgcccagtccctcctgggtcaggctggacaagcaccgtctgcatgcattgcctcctttccctttcccatttgtaccacattacctgatcccattccagtccatcccaaagatataagaggaaactcccattagtgggcacttctgctgggctgtctacatccctctccctggtcccctcttccccagcctgyttacccactctccttacctgcagcagcaggagcagcagcagcagcagccagggccaccctcagagccctgccccctccactctatctgccacccagatgtgctgtctgccggctggcccagggcctcttgtagttgctgcaggatgttgccccacatacgcggtcaccatctccccacgaggctgggtggctactttacaattgacaaaccttgggggaagtgtgactcggggaacagctcaggaagatgcagaaaaagaggggcaggctggccacccttgtgacagcttccttcctgcc

SEQ ID NO: 8236 - DNA, 601 bp, Human
ttgtaccacattacctgatcccattccagtccatcccaaagatataagaggaaactcccattagtgggcacttctgctgggctgtctacatccctctccctggtcccctcttccccagcctgcttacccactctccttacctgcagcagcaggagcagcagcagcagcagccagggccaccctcagagccctgccccctccactctatctgccacccagatgtgctgtctgccggctggcccagggcctcttgtagttgctgcaggatgttgccccacatacgcggtcaccatctccccaygaggctgggtggctactttacaattgacaaaccttgggggaagtgtgactcggggaacagctcaggaagatgcagaaaaagaggggcaggctggccacccttgtgacagcttccttcctgccatcatgatgtcacagtcctgatgggaacactcagttgcttccctttctgcaccatggtgagtctagacccacccacctgatgtccccactgcgtcactcaccccttcaggccaccaacctcctcatcactgaccactgacccctacaacccgcaagcctgcaccccagtctccctgtg

SEQ ID NO: 8237 - DNA, 601 bp, Human
tctacatccctctccctggtcccctcttccccagcctgcttacccactctccttacctgcagcagcaggagcagcagcagcagcagccagggccaccctcagagccctgccccctccactctatctgccacccagatgtgctgtctgccggctggcccagggcctcttgtagttgctgcaggatgttgccccacatacgcggtcaccatctccccacgaggctgggtggctactttacaattgacaaaccttgggggaagtgtgactcggggaacagctcaggaagatgcagaaaaagagrggcaggctggccacccttgtgacagcttccttcctgccatcatgatgtcacagtcctgatgggaacactcagttgcttccctttctgcaccatggtgagtctagacccacccacctgatgtccccactgcgtcactcaccccttcaggccaccaacctcctcatcactgaccactgacccctacaacccgcaagcctgcaccccagtctccctgtgaaatggtgctgcgcaaacaaacattgttcatcccccaaggccgggttcaagcctttctgctacatcctccctctttaatatcac

SEQ ID NO: 8238 - DNA, 601 bp, Human
ctcggggaacagctcaggaagatgcagaaaaagaggggcaggctggccacccttgtgacagcttccttcctgccatcatgatgtcacagtcctgatgggaacactcagttgcttccctttctgcaccatggtgagtctagacccacccacctgatgtccccactgcgtcactcaccccttcaggccaccaacctcctcatcactgaccactgacccctacaacccgcaagcctgcaccccagtctccctgtgaaatggtgctgcgcaaacaaacattgttcatcccccaaggccgggttcmagcctttctgctacatcctccctctttaatatcaccccgcaccatggttcccaaggacaggcacgtggcttcactcaggaagtgtggcagacatacacacccaggctccaccaccagatattctgacttggcagatctgggaagggacccaggaatctgtattttagcaacagcttaggtggttctgaggcaaggagtccaagttgaccatgtctgcaagagctgcatataggtaagatggaccctgcagcatgtctcggtgactcaggggctttgcctgagtaccaggtatgggcttcc

SEQ ID NO: 8239 - DNA, 601 bp, Human
cttcctgccatcatgatgtcacagtcctgatgggaacactcagttgcttccctttctgcaccatggtgagtctagacccacccacctgatgtccccactgcgtcactcaccccttcaggccaccaacctcctcatcactgaccactgacccctacaacccgcaagcctgcaccccagtctccctgtgaaatggtgctgcgcaaacaaacattgttcatcccccaaggccgggttcaagcctttctgctacatcctccctctttaatatcaccccgcaccatggttcccaaggacaggcacrtggcttcactcaggaagtgtggcagacatacacacccaggctccaccaccagatattctgacttggcagatctgggaagggacccaggaatctgtattttagcaacagcttaggtggttctgaggcaaggagtccaagttgaccatgtctgcaagagctgcatataggtaagatggaccctgcagcatgtctcggtgactcaggggctttgcctgagtaccaggtatgggcttccctgagctaacctgtccaggcacaggcatggagaccccagttataacagtaatagcagtaaccacc

SEQ ID NO: 8240 - DNA, 601 bp, Human
tccagtaccaaacacctttttcttttggggggacaggccccaatgtgtgagtttcaccagatgcagagttctgcttccccttctattgaggatggaagcagctattcctcccacccttctcccggcagctgtgctgcaggcacgtgacttgacctaagcctggccacatgcatgattctgcccaggaccccagatctgcggatgaggctcaaatgcagggccagttgcagattacttactcagaggcaatttaaggattcagagtctaggaatagcatggtggcctccagtatccagggcrgtggcattgatggcaacatgtccagactgtctcatgtggcctctgctgtccattctctcttggcttctgcccattttctaaacccaatcccccagcctctcatcaactctgagttactgatatccccctagaattcccttgctgttttagatagccagagttggattctgttgttagcatccaaaatcatcactggcatggttaggcactatcatgcccattaaggcaaggaggaatattgaagcccagaaggttaactgagtcacccaggatcagacaccctgcaaggatgcagagcta

SEQ ID NO: 8241 - DNA, 601 bp, Human
tgaggatggaagcagctattcctcccacccttctcccggcagctgtgctgcaggcacgtgacttgacctaagcctggccacatgcatgattctgcccaggaccccagatctgcggatgaggctcaaatgcagggccagttgcagattacttactcagaggcaatttaaggattcagagtctaggaatagcatggtggcctccagtatccagggcagtggcattgatggcaacatgtccagactgtctcatgtggcctctgctgtccattctctcttggcttctgcccattttctaaacccratcccccagcctctcatcaactctgagttactgatatccccctagaattcccttgctgttttagatagccagagttggattctgttgttagcatccaaaatcatcactggcatggttaggcactatcatgcccattaaggcaaggaggaatattgaagcccagaaggttaactgagtcacccaggatcagacaccctgcaaggatgcagagctagattcaaacccatacatggttttcctccaagacctgtgtcgttagccacacaacactattgtatcagtcaagataacagcaagaca

SEQ ID NO: 8242 - DNA, 601 bp, Human
cattctctcttggcttctgcccattttctaaacccaatcccccagcctctcatcaactctgagttactgatatccccctagaattcccttgctgttttagatagccagagttggattctgttgttagcatccaaaatcatcactggcatggttaggcactatcatgcccattaaggcaaggaggaatattgaagcccagaaggttaactgagtcacccaggatcagacaccctgcaaggatgcagagctagattcaaacccatacatggttttcctccaagacctgtgtcgttagccacamaacactattgtatcagtcaagataacagcaagacaccgctggctcattgaaactgggtaattgaggagcatttaataaacatgtgcatagaatttagggaatccagtaaggggtgcttcagtatgctgaggctggcaatagtggtgggtcattcccactgctgggcctacagaggagaggatggaacaggtggctggacttggagatgggagctgtttgctgagaggcttgaaggagccttcagaggggaatgcagccactcctgccaccacctgccagggagggagccctgaggacaga

SEQ ID NO: 8243 - DNA, 601 bp, Human
ctggaaggacccaccatcctttccccacccatgaggcccatttccctttaaagctcaaagtaggaaataacaaaatcctgattgaaatctgtgggagattgcaagacaatctcccacagagattgtctctgtggtggcctgaacacctacctgcttcaccggggagggcactggagagagcatggaaactgaggcaggtgttccaggagcagactgagagaagaggaggagggcagagtggggaactaggcaagcacatggggacagcctccagaagcctcccagggggagagcttttacyccaccatccctgacccttgtgtgatacaggaaaagaggcatttagacacaggcggaactcctggttattctattctatatggttttggggtccttcaggtaaggagcgcttcagttttcactcctgccagtgggcagtggcttattcatgtggcctcgttctagtcacatacatttctgccttcacggggctattttcaggatccagcgataaatgcacacaggatgtctgacatggtctgttgttgctctcctatggatcccatctcggcctgccagtatttccccagaagaagatact

SEQ ID NO: 8244 - DNA, 601 bp, Human
gttgctctcctatggatcccatctcggcctgccagtatttccccagaagaagatactcagtttaactcttttctctgagaaggatgcactttctcaccacgatgtcttatttctccaggttccacaatcttcaacacccttttctgggagtgttggaaagaaccacacataagcatgaaacccaagtgtctgatgctagaaagaggaagtcccagcatggggcgagcaggatgcttctgtagtgggagctctgtccaggtcaggccaaaattgtatggtccagggcaaaactgagcaggaraagtatcaggtgtgccttctgcatgtcacagcccccacaagagaattacggtgaaaagcattgagctgtctgtatttcatgccaaccccaagtggctggtggaatgaaggaccaagcatgtttggggctgtaacttcttttctgaggcacaaatgcccacccaagattattagaggaacgagggcagtgggcaggaaggtgagacgctgactttagaaatagccggtgattacagatttaattcatgttattaactccctgccttttacctcctccctcctcccttggcacaactgccag

SEQ ID NO: 8245 - DNA, 601 bp, Human
ctcttttctctgagaaggatgcactttctcaccacgatgtcttatttctccaggttccacaatcttcaacacccttttctgggagtgttggaaagaaccacacataagcatgaaacccaagtgtctgatgctagaaagaggaagtcccagcatggggcgagcaggatgcttctgtagtgggagctctgtccaggtcaggccaaaattgtatggtccagggcaaaactgagcaggagaagtatcaggtgtgccttctgcatgtcacagcccccacaagagaattacggtgaaaagcattgarctgtctgtatttcatgccaaccccaagtggctggtggaatgaaggaccaagcatgtttggggctgtaacttcttttctgaggcacaaatgcccacccaagattattagaggaacgagggcagtgggcaggaaggtgagacgctgactttagaaatagccggtgattacagatttaattcatgttattaactccctgccttttacctcctccctcctcccttggcacaactgccagatggatgtggctggaagtcagaggacattctcgtgggttcgtgggcctagggtacaaatgacctc

SEQ ID NO: 8246 - DNA, 601 bp, Human
agcaggatgcttctgtagtgggagctctgtccaggtcaggccaaaattgtatggtccagggcaaaactgagcaggagaagtatcaggtgtgccttctgcatgtcacagcccccacaagagaattacggtgaaaagcattgagctgtctgtatttcatgccaaccccaagtggctggtggaatgaaggaccaagcatgtttggggctgtaacttcttttctgaggcacaaatgcccacccaagattattagaggaacgagggcagtgggcaggaaggtgagacgctgactttagaaatagcyggtgattacagatttaattcatgttattaactccctgccttttacctcctccctcctcccttggcacaactgccagatggatgtggctggaagtcagaggacattctcgtgggttcgtgggcctagggtacaaatgacctcagcgtgacagcaaacaggacagagaagaccaggctcttactcaggaatccaccagccaggagaatgacaatgttgaacaccggaaccctgcgggagacaagaggctgaacgctactgctggcaaagtctctcccacacgcacatgttccctctagaaaa

SEQ ID NO: 8247 - DNA, 601 bp, Human
ctgtgcttttcagtctgtctcattgccaaaaactactgattagaaacaattcagtggagagtataggtccctgtccaggagaggcactggagggagacagtcgggctgatcagcccatcctcctccctgtgatgtggtagggagagaggactctggccaggaaacccgctctctattctcagtaccgtaccctgcctactgggatggtcatctcacctctttagctcggtttcctcacctataaaccgagaagaatccacccgtagtgaaaatctcatcatgaattttatagattttggcraaatgattctaaggtttctgggtaaacatcaataggtatcataataaaaagatgcaaaggagtgagggcacttggccagttccatcagcagacatgcaagcagatgagagcacaaggatgtggcatggtaagacacagggacagacagatggcaatggaacacaaaggccagatgcagagccagtgctatgcaggaacataatgtctaaggaaatcagaggtccagtggataagccggacgtggtagcatgcacccatggtcccagctacttggagaggcaggaggatcatttagtaaat

SEQ ID NO: 8248 - DNA, 601 bp, Human
gacagtcgggctgatcagcccatcctcctccctgtgatgtggtagggagagaggactctggccaggaaacccgctctctattctcagtaccgtaccctgcctactgggatggtcatctcacctctttagctcggtttcctcacctataaaccgagaagaatccacccgtagtgaaaatctcatcatgaattttatagattttggcgaaatgattctaaggtttctgggtaaacatcaataggtatcataataaaaagatgcaaaggagtgagggcacttggccagttccatcagcagacawgcaagcagatgagagcacaaggatgtggcatggtaagacacagggacagacagatggcaatggaacacaaaggccagatgcagagccagtgctatgcaggaacataatgtctaaggaaatcagaggtccagtggataagccggacgtggtagcatgcacccatggtcccagctacttggagaggcaggaggatcatttagtaaatagtcttgcagtatctggacagcaacatggtaacggtgtaggcttttctacagtttatagcatgtagcagaataaatcttcccccggactaaacat

SEQ ID NO: 8249 - DNA, 601 bp, Human
acccgctctctattctcagtaccgtaccctgcctactgggatggtcatctcacctctttagctcggtttcctcacctataaaccgagaagaatccacccgtagtgaaaatctcatcatgaattttatagattttggcgaaatgattctaaggtttctgggtaaacatcaataggtatcataataaaaagatgcaaaggagtgagggcacttggccagttccatcagcagacatgcaagcagatgagagcacaaggatgtggcatggtaagacacagggacagacagatggcaatggaacasaaaggccagatgcagagccagtgctatgcaggaacataatgtctaaggaaatcagaggtccagtggataagccggacgtggtagcatgcacccatggtcccagctacttggagaggcaggaggatcatttagtaaatagtcttgcagtatctggacagcaacatggtaacggtgtaggcttttctacagtttatagcatgtagcagaataaatcttcccccggactaaacatttaaataaaataaaaaaaaaacaatccaagaaaagtcaccaggaaatagaatcaaacacattaaggaa

SEQ ID NO: 8250 - DNA, 601 bp, Human
gcaaagcaattgatttaaaatcaacacacccacctatacaaaacttaaaaccacatgcacaaactagcaaagagggaaacggcgtaaaggagctagaaagcagaaaactgcctatttgcctgaaatccacccccattcaagggccctgacttgtagcacaggggactacattcccaagcctgactggtcgagttcagcaactggtgggggacagggggcagagacgggggcagggatggggcagagagacaggcagcaaggggcagggagccagcatctctctcacccctcacatggtggygcactcagcatcctcagcatctgccccgattccagtgctgcaacctgaatgtcctggcttccgggctctgctcactgcacctcctccccaagtctctcctgccagtgctctgcattatccactctgagtgctttaccattttcctatgctgaactcctggggcatgtccactcccaacaggccaccatctgcatttttttcgaggctgcacacaagctaccaaccccctgaagggccaggaattcatgtgcttggccttggttagagctgcccttgctcagttactgccccttataggga

SEQ ID NO: 8251 - DNA, 601 bp, Human
actagcaaagagggaaacggcgtaaaggagctagaaagcagaaaactgcctatttgcctgaaatccacccccattcaagggccctgacttgtagcacaggggactacattcccaagcctgactggtcgagttcagcaactggtgggggacagggggcagagacgggggcagggatggggcagagagacaggcagcaaggggcagggagccagcatctctctcacccctcacatggtggtgcactcagcatcctcagcatctgccccgattccagtgctgcaacctgaatgtcctggcttcygggctctgctcactgcacctcctccccaagtctctcctgccagtgctctgcattatccactctgagtgctttaccattttcctatgctgaactcctggggcatgtccactcccaacaggccaccatctgcatttttttcgaggctgcacacaagctaccaaccccctgaagggccaggaattcatgtgcttggccttggttagagctgcccttgctcagttactgccccttatagggacaactccaaatgtgacccaggagtccccagagctccttaacaagactgagccagagttatcc

SEQ ID NO: 8252 - DNA, 601 bp, Human
agcactttgggaggccgaggtgggaggatcacttgatcccaagaattcgagatcagcctgggcaacacagggagacccccatctctacaaaaataataaaaagtattagctgtcctggtggtatgcacctgtggtcccagctacttgggaggcaaaggtgggaggaggttgaggctacagtgagccatgatcgtgccactccactccagcctgattgacagagtgagaccgtgtctcaaaaaaaaaaagaaaagaaaaagaaaaaaagcttcttcttttcaaacagctagtgtggattccmctttccagactggactttggctgaaaggatagttcatattagatgatagataaagttaacagataaaagagagatgcagtctctagcagcaaggcaggagaatagggtctggaggcaggaacgtaagaccaattcatgctgaatcatggagcaacaccaaggtctaggggcaagaaatctaggatggattcgtgctgacttcccatagctggatcaaaaggaaaactcctggggctggggtcagggaacctaaggccaattaacataaactttctaaagctaaaacaaaaggaaaaaccc

SEQ ID NO: 8253 - DNA, 601 bp, Human
tacagtgagccatgatcgtgccactccactccagcctgattgacagagtgagaccgtgtctcaaaaaaaaaaagaaaagaaaaagaaaaaaagcttcttcttttcaaacagctagtgtggattccactttccagactggactttggctgaaaggatagttcatattagatgatagataaagttaacagataaaagagagatgcagtctctagcagcaaggcaggagaatagggtctggaggcaggaacgtaagaccaattcatgctgaatcatggagcaacaccaaggtctaggggcaagraatctaggatggattcgtgctgacttcccatagctggatcaaaaggaaaactcctggggctggggtcagggaacctaaggccaattaacataaactttctaaagctaaaacaaaaggaaaaaccccatctccccatgccccagcagcaaagaatcaaaggctactctccctacagccctcccccttccaccacgtctcagctggaaagggagagtgtcttagattggccctgagccaagcagagacgaccatccctttacccacagagggcgccaattcaccttagcctttagttagcca

SEQ ID NO: 8254 - DNA, 601 bp, Human
taaaagactaaatccgtgtctgtaagcctgccatgacactgctttatttatgcttaatggatcacactgcaaattgtttccaatcttttggaagaccattggtagatgctatttgtatacaaaatgatatcagtgtttaaattatctcatggaaatttcgagttaattatttaaaagaagaaaaatatatctgcaagaatatgtttatctcagagttatcaacactatatcaatgtctaagaacaggccaatggttatgtaagttatggctttcccaattgatagaaaaatatgcactcaytgaaattatatttatgaaatttaggtagcagcatcaaagaataatttcagcaaggaaaagaataaaaacatgtataattagacttactgccatattaaaatatgtataaacatgaataaagactagaagagaatatgagaaaaaagacatgttagactagtggtgatgtggaaaagtatttccatcctgataattcagtatttaatgataaacacattctaatataaatcaacatttaataactgtaaagaggtgtgaaattgctaagttagtggttcttaagtttgcctacacattaga

SEQ ID NO: 8255 - DNA, 601 bp, Human
acttggactggatgggaattctttgaaggcctctctgtgcatgccagggtcttgggcatctctccgtcccttattatctgccaagctttctggctgctggcaaacttctctagcgtgtagtcacatttcacatccagggtctgcccctctttcagttcatacttttcctcagttaatttagttgcagctcggagttctataagcagggaaagagaatgggttctgtgaggaattatttttctctctctgagtggggaaaaaggagaggagccccctgtttttcttgtccaaccacccatayttcagatgaggttcttgaggcctccagagaaaatacaacttgccctgcaagccagcactagacctcagatctttccactgtgagtaggttttttactataagagactgcatatggtgcatgaggatcaaatttcataaatgatcagaagaggaagactgactttgagaggaagaaactgcctgcctggagacagaacatgggatattgtactaagaccacgagtggctgcagcatggtgggagggatcgattacaagggcgtatgacataaaaagtgaacgcaaagacacggtgctagca

SEQ ID NO: 8256 - DNA, 601 bp, Human
gaattctttgaaggcctctctgtgcatgccagggtcttgggcatctctccgtcccttattatctgccaagctttctggctgctggcaaacttctctagcgtgtagtcacatttcacatccagggtctgcccctctttcagttcatacttttcctcagttaatttagttgcagctcggagttctataagcagggaaagagaatgggttctgtgaggaattatttttctctctctgagtggggaaaaaggagaggagccccctgtttttcttgtccaaccacccatatttcagatgaggttcytgaggcctccagagaaaatacaacttgccctgcaagccagcactagacctcagatctttccactgtgagtaggttttttactataagagactgcatatggtgcatgaggatcaaatttcataaatgatcagaagaggaagactgactttgagaggaagaaactgcctgcctggagacagaacatgggatattgtactaagaccacgagtggctgcagcatggtgggagggatcgattacaagggcgtatgacataaaaagtgaacgcaaagacacggtgctagcagagagtggctccaag

SEQ ID NO: 8257 - DNA, 601 bp, Human
gcctccagagaaaatacaacttgccctgcaagccagcactagacctcagatctttccactgtgagtaggttttttactataagagactgcatatggtgcatgaggatcaaatttcataaatgatcagaagaggaagactgactttgagaggaagaaactgcctgcctggagacagaacatgggatattgtactaagaccacgagtggctgcagcatggtgggagggatcgattacaagggcgtatgacataaaaagtgaacgcaaagacacggtgctagcagagagtggctccaaggacascttgaggaacttcatctaagtcagggcaaggagatcagctcaaaagacctttggacaaacagtgaggaagccgtctggagggcatgatgggcatggatatctgactgcctggcactcctttttcccttccttgggtagcagagcacccctttccaagggaacgatcctgtgtggctctactgttggggcagcccacattctcaaggatgggcacaggacacaggatttgccaatccaagtaccccatctcggggccaggcacagtggctcacgcatgtaatcccacactttgggaggatg

SEQ ID NO: 8258 - DNA, 601 bp, Human
cccatctcggggccaggcacagtggctcacgcatgtaatcccacactttgggaggatgaggaggtcagatcacctgaggtcgggagttcgagaccagcctggccaacatggtgaaaccttgcctctactaaaaatacaaaaaaattagccaggcatggtggtgcacacctgtagtcccagatacatgggaggctgaggtgggagaatcacttgaacccgggaggtggaggttacagtgagccaagatcacaacactgcactccagcctgggccacagggcaagactctgttaaaaaaaaacacacacacacacacacacacatacacaaagtaccccatctccctgccaggctgattggtttaggaaggagcacatggctgagctggaccaatcagagtcctccctgagactgctgtagccattaatggaaatgcttcttgctgggattcacaggtcaatgagatgtgaaactttattatgtgaaactttctaccacgtaggaataggctgcccgagaatggctaaacaggcagaaagtgagtgggaggaaggaagagggggatagtggaggggagagaaagaaagagagaaaaaaaccca

SEQ ID NO: 8259 - DNA, 601 bp, Human
atctacagtgcacaggacagcccccacaacaaagaatcatcccaccccaaatgtcaatagtgccatgtttgagaacccctgggttacagtgacaatagtttccatcacattcttggagtccgaactgggttaaccatctagaattggggatgctcatctggccttgtccaagggagccttgctgatgggaggccaagcagagcggaagtgagaagaccaaggtccgtgttttcagctggacacacagggctctctaagtttgctgagagactgtagcttacccactcaggcctggggtacyttcccccatggagcaccaaataacaggctagacagtgctgctgggtctactgtgtgggtcacggtaacactagtactgctgttattaataccacacacttaggtccttgcaggcctggtgaaaaatgacaagtgcttaccctttcatggagccccctggcatgcccaccccaggataggccaacagatctgcctgaccttaggaagactcaactcagggactcacaaggagtttaaaggtgaaatcagtcttgaaagccagttcttctgggagcagactccagtttctagggaaacctcg

SEQ ID NO: 8260 - DNA, 601 bp, Human
agcaaatactacctattaagtattatgtgctaagggtttttaaagactatcttatttaatctttataaagtaaaaagttgacaccattattctccccattttatagataaggaaactgaggcacagacagattaagtgatttgcccaaagtctcaccatagttaagtactagagccaggattcaaacccaaggactctggttccacctaaagcactgagctacatggtccaacacagtctgatagggattagagaagtcctggcccaagtgtgaataagtatccagttgcaaggagcattsaggttaacccctaacctatccccacagggcacaatgaaatatataccactggttttctctcacacaggtacataaccttcagccctctgccatctcccagttctccttcagaaaaacatgaatcaaacacaaggaaatgcacttgtccatgaggagctaactcccttctgcccatctagattatcaccccagctccaagaagacccagagcaatgtctgagcacaggctcttcaaggcagttgtccatgactttgctcaaagtagagagcccaggaggatacctctccctgatttttcat

SEQ ID NO: 8261 - DNA, 601 bp, Human
aacacagtctgatagggattagagaagtcctggcccaagtgtgaataagtatccagttgcaaggagcattgaggttaacccctaacctatccccacagggcacaatgaaatatataccactggttttctctcacacaggtacataaccttcagccctctgccatctcccagttctccttcagaaaaacatgaatcaaacacaaggaaatgcacttgtccatgaggagctaactcccttctgcccatctagattatcaccccagctccaagaagacccagagcaatgtctgagcacaggctyttcaaggcagttgtccatgactttgctcaaagtagagagcccaggaggatacctctccctgatttttcatgccttcccaaggcaagcctcgcttttaactcatattgacactttcctcctgttattcataaggattaggaggaggagtgaataaagcccgcatgcttctggtttgggtgcagatgtgagctgtgcggatcgtaagaggagacacaagaaagagctggggcatgcgccggctctgctgagcctcagcaactgtgccctccaaccccagcgtgccatggagagctgggatga

SEQ ID NO: 8262 - DNA, 601 bp, Human
cccacagggcacaatgaaatatataccactggttttctctcacacaggtacataaccttcagccctctgccatctcccagttctccttcagaaaaacatgaatcaaacacaaggaaatgcacttgtccatgaggagctaactcccttctgcccatctagattatcaccccagctccaagaagacccagagcaatgtctgagcacaggctcttcaaggcagttgtccatgactttgctcaaagtagagagcccaggaggatacctctccctgatttttcatgccttcccaaggcaagcctcrcttttaactcatattgacactttcctcctgttattcataaggattaggaggaggagtgaataaagcccgcatgcttctggtttgggtgcagatgtgagctgtgcggatcgtaagaggagacacaagaaagagctggggcatgcgccggctctgctgagcctcagcaactgtgccctccaaccccagcgtgccatggagagctgggatgatcacctccaccaaaatgagcaccagcctcttctggtcacgtctgtgtcctcagcagtagtatatttgctgtcccatagtagacccctggga

SEQ ID NO: 8263 - DNA, 601 bp, Human
tctcacacaggtacataaccttcagccctctgccatctcccagttctccttcagaaaaacatgaatcaaacacaaggaaatgcacttgtccatgaggagctaactcccttctgcccatctagattatcaccccagctccaagaagacccagagcaatgtctgagcacaggctcttcaaggcagttgtccatgactttgctcaaagtagagagcccaggaggatacctctccctgatttttcatgccttcccaaggcaagcctcgcttttaactcatattgacactttcctcctgttattcwtaaggattaggaggaggagtgaataaagcccgcatgcttctggtttgggtgcagatgtgagctgtgcggatcgtaagaggagacacaagaaagagctggggcatgcgccggctctgctgagcctcagcaactgtgccctccaaccccagcgtgccatggagagctgggatgatcacctccaccaaaatgagcaccagcctcttctggtcacgtctgtgtcctcagcagtagtatatttgctgtcccatagtagacccctgggaaatatttgttaaatcaattctgtcttttgggtttaac

SEQ ID NO: 8264 - DNA, 601 bp, Human
gagagcccaggaggatacctctccctgatttttcatgccttcccaaggcaagcctcgcttttaactcatattgacactttcctcctgttattcataaggattaggaggaggagtgaataaagcccgcatgcttctggtttgggtgcagatgtgagctgtgcggatcgtaagaggagacacaagaaagagctggggcatgcgccggctctgctgagcctcagcaactgtgccctccaaccccagcgtgccatggagagctgggatgatcacctccaccaaaatgagcaccagcctcttctgrtcacgtctgtgtcctcagcagtagtatatttgctgtcccatagtagacccctgggaaatatttgttaaatcaattctgtcttttgggtttaacagattgtcaacatcaaacacatcatgatggaatataagaaaaaaatttcaacatcaaataaacttattgtagatcatgccatgatgagatctactctatcattattcccatactaggctttgcatgtctctaacaacatcgacatgcacagacatcttttttccctgactctctccttcttttacttttgtgtgcagacactgcatg

SEQ ID NO: 8265 - DNA, 601 bp, Human
cctgatttttcatgccttcccaaggcaagcctcgcttttaactcatattgacactttcctcctgttattcataaggattaggaggaggagtgaataaagcccgcatgcttctggtttgggtgcagatgtgagctgtgcggatcgtaagaggagacacaagaaagagctggggcatgcgccggctctgctgagcctcagcaactgtgccctccaaccccagcgtgccatggagagctgggatgatcacctccaccaaaatgagcaccagcctcttctggtcacgtctgtgtcctcagcagtrgtatatttgctgtcccatagtagacccctgggaaatatttgttaaatcaattctgtcttttgggtttaacagattgtcaacatcaaacacatcatgatggaatataagaaaaaaatttcaacatcaaataaacttattgtagatcatgccatgatgagatctactctatcattattcccatactaggctttgcatgtctctaacaacatcgacatgcacagacatcttttttccctgactctctccttcttttacttttgtgtgcagacactgcatgttctcccaattctgggtagagca

SEQ ID NO: 8266 - DNA, 601 bp, Human
ttcagaaatattcccaaatgtgaaatgaataaagacatttagaagagctcagaaatttaagggaggacaaatcacagaattccaatctacaaatcagagatgtccttaaagcataaaatggaatggtggatcacaagcaagattaaaaattttatcttaaaaaatatgctttccaggtctgagaagaaatctaaaattggaggttgagagttcaacatgggcaaggaaaaaattcacaaagtgagacctagaataggaagtttccaggtgaaaatttttaaatttaaataaaaagattccyactgctaaataaacaaaaaagtaacttggtttcttcaaaggaattgaaataatcaggactcagatttcttctctgagtaacaaataccatgagagagtgggatgaggtataaagaacattatgaccctaatattttacacccaaattgattgctactcaagtataggaacagctaaaaggtactatcatgtctgtaaattaaaacaaacaacaaccaaaaaaattttcaaggctaactttaattttttttattaaagctgttcaatgcagcaatttataaaatatagaaaataatacata

SEQ ID NO: 8267 - DNA, 601 bp, Human
accatgagagagtgggatgaggtataaagaacattatgaccctaatattttacacccaaattgattgctactcaagtataggaacagctaaaaggtactatcatgtctgtaaattaaaacaaacaacaaccaaaaaaattttcaaggctaactttaattttttttattaaagctgttcaatgcagcaatttataaaatatagaaaataatacataaacttaaatcatgttattacactttatagagatcatttgtagtggagattttactatgtttattttttgttctacaaataatgtcrgaaaacaggcttcaaacatgcttgaactgaaatctgctggcccctccttttgctgtactcaagcagtccctaaagaggaaaaatagacagaaagctcttgacattttctgactcagagaggagcctacgtgacttctgtggcgatgagtcaaattaataaagtttatttcagtgaataaatcccctccttacaacaaaattaatattccacacttaaataatagctatttcacatactttctacatttttgtgtcttcatatactttgtgtggaggattaagctcctggaagattaagag

SEQ ID NO: 8268 - DNA, 601 bp, Human
agatcatttgtagtggagattttactatgtttattttttgttctacaaataatgtcggaaaacaggcttcaaacatgcttgaactgaaatctgctggcccctccttttgctgtactcaagcagtccctaaagaggaaaaatagacagaaagctcttgacattttctgactcagagaggagcctacgtgacttctgtggcgatgagtcaaattaataaagtttatttcagtgaataaatcccctccttacaacaaaattaatattccacacttaaataatagctatttcacatactttctayatttttgtgtcttcatatactttgtgtggaggattaagctcctggaagattaagagggagctttgaactaaacagtccaagaagaatttttaattagacttgaatatcactggaggctgattgctccttcacattttcctaactacggacagcacctgcatttaaattagaatgaagtagaatgaggtctttctccacttgtctgatctatttgtgtacttgaggtcaacagtgcaaatagtcacgtgtcacttaatgacagatacattctgagaaatgtgttgctaggtgattttgtgt

SEQ ID NO: 8269 - DNA, 601 bp, Human
gacccgatcagtaacttcttcaggctgaataggcaggacgatattcctgcctaactattagggtctctttaaattctcaagctactgctcccaacaagatattatttcttaaggcttctcatagaagagcactgtcatttgtgacctatggttcctgttaattttactaaggctgggtcacatgtcccatttccatgcttgctcatagggtggcctctagcactaggaagatttagtctttgggtaccatgaacctttccatatttgccaaacttcatcttcagagctattatgaaatcartacagtttcaacattgatacaattaatgaaataataccaatattattctgttttgttttgtcttcaataagtcactgccccaagtcagtaggtctcgatcttcactatggggtaaattagcagtttcttccttaataaagattggttaatctaacctagctagaatatatgtgtaacattttttaacaatgagattgcatataaaatatcttcttttctggctcagaggaggggcccacatggaactggaacacagatctctgaggatagtgtgaccctggtgctgatatctctgaggag

SEQ ID NO: 8270 - DNA, 601 bp, Human
tcaagctactgctcccaacaagatattatttcttaaggcttctcatagaagagcactgtcatttgtgacctatggttcctgttaattttactaaggctgggtcacatgtcccatttccatgcttgctcatagggtggcctctagcactaggaagatttagtctttgggtaccatgaacctttccatatttgccaaacttcatcttcagagctattatgaaatcaatacagtttcaacattgatacaattaatgaaataataccaatattattctgttttgttttgtcttcaataagtcackgccccaagtcagtaggtctcgatcttcactatggggtaaattagcagtttcttccttaataaagattggttaatctaacctagctagaatatatgtgtaacattttttaacaatgagattgcatataaaatatcttcttttctggctcagaggaggggcccacatggaactggaacacagatctctgaggatagtgtgaccctggtgctgatatctctgaggaggcccaatgagactacttctgagagtggggaaaactgcaaactggaaccagtcactgttgcccgtgaaaagcatcac

SEQ ID NO: 8271 - DNA, 601 bp, Human
ctattatgaaatcaatacagtttcaacattgatacaattaatgaaataataccaatattattctgttttgttttgtcttcaataagtcactgccccaagtcagtaggtctcgatcttcactatggggtaaattagcagtttcttccttaataaagattggttaatctaacctagctagaatatatgtgtaacattttttaacaatgagattgcatataaaatatcttcttttctggctcagaggaggggcccacatggaactggaacacagatctctgaggatagtgtgaccctggtgctratatctctgaggaggcccaatgagactacttctgagagtggggaaaactgcaaactggaaccagtcactgttgcccgtgaaaagcatcactgaggctactcacaatgaaagagaatgaaataggaatcagtgagcatgtcctgtcttcctcctccagcctcccaatctccctctaatgcccctatcgagagtccagcagggaaccagccagcaaagacaaagcgagtttcagaatctccactcaaaccaaggtaaagaagtgttaatcagagagacgatgactgaataaccagctcactc

SEQ ID NO: 8272 - DNA, 601 bp, Human
ctgaggatagtgtgaccctggtgctgatatctctgaggaggcccaatgagactacttctgagagtggggaaaactgcaaactggaaccagtcactgttgcccgtgaaaagcatcactgaggctactcacaatgaaagagaatgaaataggaatcagtgagcatgtcctgtcttcctcctccagcctcccaatctccctctaatgcccctatcgagagtccagcagggaaccagccagcaaagacaaagcgagtttcagaatctccactcaaaccaaggtaaagaagtgttaatcagagagrcgatgactgaataaccagctcactcacacagtcaaacaagagcactccacgtgtctgaggcctcacctagcagtaaagcagacaagttgaatagttaagaatcacagtggcattttatgaagaactttcttagcatagctagggggcatggctaatttcacatgtccccaggccttatctagaatcaatgctccaaaataaattgaacaacttttaaaagtcaaagaagcagtttatgaccttaaagcatttaggaaacttaatatctgacctgcataatttagaccaaatatttacatt

SEQ ID NO: 8273 - DNA, 601 bp, Human
gttaatcagagagacgatgactgaataaccagctcactcacacagtcaaacaagagcactccacgtgtctgaggcctcacctagcagtaaagcagacaagttgaatagttaagaatcacagtggcattttatgaagaactttcttagcatagctagggggcatggctaatttcacatgtccccaggccttatctagaatcaatgctccaaaataaattgaacaacttttaaaagtcaaagaagcagtttatgaccttaaagcatttaggaaacttaatatctgacctgcataatttagacyaaatatttacatttttgaaaatatttttattttaccaataatctttaaaactgtttttatttcccaaagattacttaagtcatatgaaccaaaagacattacactttttaacttttttgacaaaatatttgatttaagcacttatttttaaaccaattaatctagctattttatattacacacacataattcatataaatacatagacagaagatagaggacttatacccaagccaggaatcaaaccctgaacccagcctgccattgtgaaaagagaacatggccacatggttacaaggt

SEQ ID NO: 8274 - DNA, 601 bp, Human
tttgacaaaatatttgatttaagcacttatttttaaaccaattaatctagctattttatattacacacacataattcatataaatacatagacagaagatagaggacttatacccaagccaggaatcaaaccctgaacccagcctgccattgtgaaaagagaacatggccacatggttacaaggtcaagctcccaaggacatacaagacaggaaggaaatctcatccagttttttcaggaacctgcagcaaagtttgtaactgactggtttactgggctgtcttgaaaagcaggcttacasgtaggtgtcttaggcttgtgttctatcctaaagtactcctctgcattatagaacacagaaagacacacaaaacataccaaattcactacagcttaagactagcttcatgaattaattcttccattaatcaaaactttacagaggagataaacagtgatttttaccattcattcaaccagtttgcacagagagagagaggagaaaggattgcctaaggcagggtgaggaaggcactcagggaggccagagaaagacacacccattgcagcgacactgaaaagttcgggcagccgcttgctg

SEQ ID NO: 8275 - DNA, 601 bp, Human
gacttatacccaagccaggaatcaaaccctgaacccagcctgccattgtgaaaagagaacatggccacatggttacaaggtcaagctcccaaggacatacaagacaggaaggaaatctcatccagttttttcaggaacctgcagcaaagtttgtaactgactggtttactgggctgtcttgaaaagcaggcttacaggtaggtgtcttaggcttgtgttctatcctaaagtactcctctgcattatagaacacagaaagacacacaaaacataccaaattcactacagcttaagactagcytcatgaattaattcttccattaatcaaaactttacagaggagataaacagtgatttttaccattcattcaaccagtttgcacagagagagagaggagaaaggattgcctaaggcagggtgaggaaggcactcagggaggccagagaaagacacacccattgcagcgacactgaaaagttcgggcagccgcttgctgatcatgaaggaattttttccagcagtgccatcagctctcaagtttcccctttttaggaaggaaaatgctccccatgccccctgatcctgtacatgcttaaccct

SEQ ID NO: 8276 - DNA, 601 bp, Human
ttgtgaaaagagaacatggccacatggttacaaggtcaagctcccaaggacatacaagacaggaaggaaatctcatccagttttttcaggaacctgcagcaaagtttgtaactgactggtttactgggctgtcttgaaaagcaggcttacaggtaggtgtcttaggcttgtgttctatcctaaagtactcctctgcattatagaacacagaaagacacacaaaacataccaaattcactacagcttaagactagcttcatgaattaattcttccattaatcaaaactttacagaggagatmaacagtgatttttaccattcattcaaccagtttgcacagagagagagaggagaaaggattgcctaaggcagggtgaggaaggcactcagggaggccagagaaagacacacccattgcagcgacactgaaaagttcgggcagccgcttgctgatcatgaaggaattttttccagcagtgccatcagctctcaagtttcccctttttaggaaggaaaatgctccccatgccccctgatcctgtacatgcttaaccctgtcacccacagccatcagcaaagagtgcaaagcagattatttcca

SEQ ID NO: 8277 - DNA, 601 bp, Human
ttcactacagcttaagactagcttcatgaattaattcttccattaatcaaaactttacagaggagataaacagtgatttttaccattcattcaaccagtttgcacagagagagagaggagaaaggattgcctaaggcagggtgaggaaggcactcagggaggccagagaaagacacacccattgcagcgacactgaaaagttcgggcagccgcttgctgatcatgaaggaattttttccagcagtgccatcagctctcaagtttcccctttttaggaaggaaaatgctccccatgccccctgatcctgtacatgcttaaccctgtcacccacagccatcagcaaagagtgcaaagcagattatttccaagagaacagcaattaattcccatagtgctaaattcgttcttagccaaaagggactttaccaagagggactttaccgacaggggcctctaaccccctaaatcttagaagggactctaaccctcataagttgggcctctaacccagttggtcaggcgttcttgccttttattaagagggggctgtaacccactatgtcttaggagagactctaactcctttaaattgggcctcta

SEQ ID NO: 8278 - DNA, 601 bp, Human
gactagcttcatgaattaattcttccattaatcaaaactttacagaggagataaacagtgatttttaccattcattcaaccagtttgcacagagagagagaggagaaaggattgcctaaggcagggtgaggaaggcactcagggaggccagagaaagacacacccattgcagcgacactgaaaagttcgggcagccgcttgctgatcatgaaggaattttttccagcagtgccatcagctctcaagtttcccctttttaggaaggaaaatgctccccatgccccctgatcctgtacatgcytaaccctgtcacccacagccatcagcaaagagtgcaaagcagattatttccaagagaacagcaattaattcccatagtgctaaattcgttcttagccaaaagggactttaccaagagggactttaccgacaggggcctctaaccccctaaatcttagaagggactctaaccctcataagttgggcctctaacccagttggtcaggcgttcttgccttttattaagagggggctgtaacccactatgtcttaggagagactctaactcctttaaattgggcctctaacccaatcccattct

SEQ ID NO: 8279 - DNA, 601 bp, Human
aacccactatgtcttaggagagactctaactcctttaaattgggcctctaacccaatcccattctttacccggtatatgcaccccacttacccaaagtccgccagtcagtgctgcagtctatttcctttgcattggagggtctgctcagtatcgtcccttccgtggttcacaagaaagatgttaaaaaaacatcctcagatgttttttaatgattttttcctaaatgaagttcttttaattttcagaccaaccaaacatttttaatataaaaacattttaataatatacaaacagcaatcraaacggcatccacttggaagcgaaaggactggggcacagatgggggagtggactaaagagggacggttttcagggtcccagttgcttcccttgcctgaaatcactctggtcttagcagagggaagattaaggcatccagaggcagaggggccctgaccctgacccagagacagactaagcacagcaggcccctctaacatcaccttcccaccatgacagcctccagggaaagccagatccagttacaagagaacaggaaggtggctgtgattaacaggaaaggcaaccatcgttcctcag

SEQ ID NO: 8280 - DNA, 601 bp, Human
aatcccattctttacccggtatatgcaccccacttacccaaagtccgccagtcagtgctgcagtctatttcctttgcattggagggtctgctcagtatcgtcccttccgtggttcacaagaaagatgttaaaaaaacatcctcagatgttttttaatgattttttcctaaatgaagttcttttaattttcagaccaaccaaacatttttaatataaaaacattttaataatatacaaacagcaatcaaaacggcatccacttggaagcgaaaggactggggcacagatgggggagtggacwaaagagggacggttttcagggtcccagttgcttcccttgcctgaaatcactctggtcttagcagagggaagattaaggcatccagaggcagaggggccctgaccctgacccagagacagactaagcacagcaggcccctctaacatcaccttcccaccatgacagcctccagggaaagccagatccagttacaagagaacaggaaggtggctgtgattaacaggaaaggcaaccatcgttcctcagcaacctgttgatcacacctctgggaatagagttttccagtgactgctggattga

SEQ ID NO: 8281 - DNA, 601 bp, Human
atattacattgtaaaggaggaaaatgtcacagtcatatcaacagatgcagaaaaagcatttgacaaaattcaactctcttttatgataaaatactcaataaactaggataagaagggaatttcctctatgcaataaagggcatctattaaaaaagaccctacaactaacatatttaatgacgagagactgcaagctttctctctaagatcaggaataagacaagaatgtcttctcagccaactctgttcaacattgtactggaggttctagccagggcaattaggcaagaaaataaaaggyatccaggttagaaacaaagaagttaaatttgtacgtaggaaattctatggaatttttaagaaaactattagagctaattaacaagttcagcaaagttacaggatataagatcaatatataaaaatcagttgtatttctacttactagcaataaacaatctgaaaatgaaatgaaattaagaaagcaatttcctttataatggcatccaaagcaatgaatatttaagaacaaattgaacaaaagaatgcaagatttgcacactaaaaactacaaaacattgttatctggcagagtctttgc

SEQ ID NO: 8282 - DNA, 601 bp, Human
agaaaaagcatttgacaaaattcaactctcttttatgataaaatactcaataaactaggataagaagggaatttcctctatgcaataaagggcatctattaaaaaagaccctacaactaacatatttaatgacgagagactgcaagctttctctctaagatcaggaataagacaagaatgtcttctcagccaactctgttcaacattgtactggaggttctagccagggcaattaggcaagaaaataaaaggcatccaggttagaaacaaagaagttaaatttgtacgtaggaaattctawggaatttttaagaaaactattagagctaattaacaagttcagcaaagttacaggatataagatcaatatataaaaatcagttgtatttctacttactagcaataaacaatctgaaaatgaaatgaaattaagaaagcaatttcctttataatggcatccaaagcaatgaatatttaagaacaaattgaacaaaagaatgcaagatttgcacactaaaaactacaaaacattgttatctggcagagtctttgcctttttgtacccactcacccagcttgggtcctatctccactactttat

SEQ ID NO: 8283 - DNA, 601 bp, Human
aactacaaaacattgttatctggcagagtctttgcctttttgtacccactcacccagcttgggtcctatctccactactttatgttttctgctccaggaggccctaggtgactctgctgcagcctctatcatcctgtgacctgcaggatctcagtaagacggctaactagatgcagccaggaggaacatctgccacctaaggatggtgacatagagaagactggtgcactgagggaaggcactgagagtggatggagggaggacacagatgctgggctgaaggggagagaaagctgggaaycttgcacgggccatcataccttgggactcattcctggcccccaacaactctggggaacaggtgagttgagcaggcaaggcgtgacccacttttgccacagacctctagaatcctggcagcaggagaccccacaaccccaaagacacttgagctggcagggggagctgcttagagaggtagtaagggcaggactccagcctgtgtagagcccagagggtttagtgtgggaatgtctgtggtggagcacagctggggatgcccataccacaaggctcaccatgatctcctaggagattttag

SEQ ID NO: 8284 - DNA, 601 bp, Human
cgctttcccagcacatgtgtgtgtgggcggatctcacctcccctcccccgctgctgcatgtgtgcatgtgaacctcactgtgctactactgcaggcatgagcctacccctgccccagccatgctgccattgccagtgtgaacacaggcacacaggccccacctcccaccccacactgccaccaccactagcacaaacacacacacgtagtggccctcagcctcacagccaccaggaccctaccccagccaacaagcgtgcaccctgctatgctgctgctgctgctgctgctgctgctgctcacacacacaaacacacatggatcctgctgccatcaccctgacaaagtgctttggctggtaccacccatcagagtgtcatgaccagaggccccagaatacctctgtccctctagcatggctggttcctaacctcaaggggccagagaacaaagctgggggcctcattccagcgcccccagagttagagcctgcagcttaggagtgctgagttgagccttggccccctaacatcttccagaaacaaagccagtcaacaggacccatcttataccacaatcaaacccccaaggccatcaatga

SEQ ID NO: 8285 - DNA, 601 bp, Human
gcacaaacacacacacgtagtggccctcagcctcacagccaccaggaccctaccccagccaacaagcgtgcaccctgctatgctgctgctgctgctgctgctgctgctgctgacacacacaaacacacatggatcctgctgccatcaccctgacaaagtgctttggctggtaccacccatcagagtgtcatgaccagaggccccagaatacctctgtccctctagcatggctggttcctaacctcaaggggccagagaacaaagctgggggcctcattccagcgcccccagagttagagcytgcagcttaggagtgctgagttgagccttggccccctaacatcttccagaaacaaagccagtcaacaggacccatcttataccacaatcaaacccccaaggccatcaatgaagataaaagcaaataaacccgtccaaaggacagcagcttcaaagattgaagaaacatcagcccacacatatgagaaggaatcagcacaagaactctggccactcaaaaagtcagaggtctttttacctccaaatgacaacactagttacccagcaatggttcttaaccaagtgaaatggttgaatgaca

SEQ ID NO: 8286 - DNA, 601 bp, Human
cccagaatacctctgtccctctagcatggctggttcctaacctcaaggggccagagaacaaagctgggggcctcattccagcgcccccagagttagagcctgcagcttaggagtgctgagttgagccttggccccctaacatcttccagaaacaaagccagtcaacaggacccatcttataccacaatcaaacccccaaggccatcaatgaagataaaagcaaataaacccgtccaaaggacagcagcttcaaagattgaagaaacatcagcccacacatatgagaaggaatcagcacaagaactctggccactcaaaaagtcagaggtctttttacctccaaatgacaacactagttacccagcaatggttcttaaccaagtgaaatggttgaatgacaaaaacagaatttagaatgtgtataggaacaaagatcattgagattcaggagaaagccaaaacccaatccaaggattctagggaatacaataaaacaatataggagctgaaagacaaaatggccgttttcagaaagaaccatactgatttgatagagccaaaaaactcacttcaagaattttataatacaatcagaagtatt

SEQ ID NO: 8287 - DNA, 601 bp, Human
tattctgtggtgtgtggatggatagatagatagatagatagatagatagatagatagatagataccatatatttgtatccacttatcagttagttggcagttaggatgattccatataattgcaattgtgaattatgctgcatacatttagcattcttaaagaaaagagatgccaaccaagagtttcatatccagccgaactaagcttcataagtgaaggagaaataagatccatgtcagacaaacaattgctaaggcaattcattactactagacttgtcttacaagaggtcctgaaggragtattaaatttgttaaagaaagaccattaccagctgatataatctggatatttgtccccacccaaatgtcatgttgaaatgtaatctccaatcttggtggtagggcctggagggaggtgtttggatcaagtgggtggatcccaaatgaatggcttgggccatgacttggtgacaagtgagctctcactctgagttcacacaagatctggtcatttaaaagtgtgtagcacctcccccagtatcaggggaaccagcccccaatatttcaacgtagattcatttctattttccctaagtgt

SEQ ID NO: 8288 - DNA, 601 bp, Human
catcctaaacaaactaatggaaaaacagaaaaccaaatacctcatgctctcacttttaagtgggaactaaacattgagtacatatggacacaaagaagggaataacagatacctgggtactgtgcttattacctgggtgatgaaataatctgtacaccaaattcctgtggcatgcaatttacctatgtaacaaacctgaacatgtatttctgaacctaaataaaagttactttttaaaaaagaaatatggtaataaaattaaatccttacagtttaaaaatacatatataaaatgcttcaygaatttgcatgtcatctttgcaaaggggcaatgctaatcctctctgtatcattccaattttagtatatgtgctgccaaagtatgaacaggactattaagttgaggttattaggtcatggggatcttcccttatgaatggattaatgctggtattggggaactggattagttattgcaggagtgtgttcctgacaaaaggatggtgatatggtttggctctgtgtccccactcaaatctcatgttgaattgtaatacccaatgttgtgggagagacctggtgggaggtggttggatcatgg

SEQ ID NO: 8289 - DNA, 601 bp, Human
ggacacaaagaagggaataacagatacctgggtactgtgcttattacctgggtgatgaaataatctgtacaccaaattcctgtggcatgcaatttacctatgtaacaaacctgaacatgtatttctgaacctaaataaaagttactttttaaaaaagaaatatggtaataaaattaaatccttacagtttaaaaatacatatataaaatgcttcatgaatttgcatgtcatctttgcaaaggggcaatgctaatcctctctgtatcattccaattttagtatatgtgctgccaaagtatgmacaggactattaagttgaggttattaggtcatggggatcttcccttatgaatggattaatgctggtattggggaactggattagttattgcaggagtgtgttcctgacaaaaggatggtgatatggtttggctctgtgtccccactcaaatctcatgttgaattgtaatacccaatgttgtgggagagacctggtgggaggtggttggatcatggcagaggatttcccctttgctgttctcatgttggtgagtgagttctcatgaaatacgatggtttaaaagtgtgtggcacttcccct

SEQ ID NO: 8290 - DNA, 601 bp, Human
gagaactatgcatattctttttcattcttagcccaaatatcttggcatttattttacattgtatttatccagagtattctccctgttagtattacctaacaacataccagtaaactgaaaaaaaaaaattctgttctagcctcagggagagattagggagggtacctaataactttagagagaattccatgtgataaatgaaagggagagtatagacaagattacagccagtatagctgggattacagccatgtaccaccacgcccagctaatttttgtatttttagtagagacggggttycgccatgttggccaggatgttctccaactcctgacctcatgtgatccgcccacctcggcctcccaaagtgctgattacaggcctgagccaccacacccagccaacaagacccaattatacagacatcagctacttacacaataatcagttcaatcatggtacttttaaattatgaaagaattctatcataaacccttagccatttaagttttgtagggggaaaatgccattcattcaacagtaagtgcactattacaaaaaaaaaaaaaaagaaagcaaagttgcttttttttttcgaga

SEQ ID NO: 8291 - DNA, 601 bp, Human
gagcccccaccaccaagtccattctgagttaagggttaggaatactctgagccattgttgtgattggtcttctcagagagatctctggactgtcaccaggcaccctgaggacacaggagagagtgaccagagtattgatcactggtcataggaagacggatttcctcttattgtccttgttcatggacccctgggctgaaagaaaggaacagagacagagcaggaaagaggaagatcaggaagcaggaacagagtcagaggaaaattgcaggcttgatgggaaggggcaggcttggggggytctagagttattgatttttcagcttgatcaacttttacttgttaggatggagtgacaattttcaagctccttacttgccagactgggagctggaaatcctattgttttttacatgcatttaactttaatcaagttaccataacacctcactgactccaaaataagtttctatctcagcatggcattctttctccacggactgacccacccaccactcaaccttatcacttcttatgcttttctaagaaaatagcatgggacctacaaaagagtaaaaaactgtcaagattttgaagaatg

SEQ ID NO: 8292 - DNA, 601 bp, Human
tgctctatccattccagccttgcagcctcaaacatgcaaaagtcagccacacgtgtttgttctgttgtgtgatttaaccctacatgtagaaatggaaatggaagagaatatgacatgagaaaaccaaaggacatagcagtattatatgttcctaaatgaagctgagtttatgtgtgtgtgtgcaggaatgtgccttcacgtatagctcacaggtatgcatgtgcatttgtgtacctatgtgtgtgcgtgtatgtgggttagcatgcatgtgtatatgtgagtgtgtctgagtattcttacmcccaatgctccaaacataacattgattaaagtccacagtgagtgagctgagtttgtggggtcctctgtaaaacagaaggaaaaatccattttcaacgagagagggatgtttgtgagctccccaagaacacgctggtggtcctagggcagcaggatggtaacctccagggttcttgacaacaacggaccagggaagccaataaaggatctgtcagtggtctccagggcctgcaggcagtgcctctggcaggccatgctctctggtcactgggaagatggacccttgagaaggtcacagcca

SEQ ID NO: 8293 - DNA, 601 bp, Human
tgggaaacctatttaccaagtggaatggtttcatacaaaatactacgggtatagctcttctaaagattttttcaatcccttaggtatctttttctattggatataattttaaggagtgcccacaaatacattttgaactagtttttacttatttttctacttacactaagtacttatccaacttttagtataacatatgcaagttatcagacttcattaacccttgttgagtggtctagccttttttggggttaaaaaaattattttctgggccaggtacagtgagtcatacctgtatccyagcactttgggaggccgaggcaggaggatcacttgagctcaggaatttgaggccagcctgggcaacatagggagactccatctttacaaaaaaaaaattaaaaattagtcaagcaaggtgacacatgcctgtagtcccagctactcaggaggctgaggtgggaggatcagctgaacccagaaagtcaaggctgcagtgaactgtgattgtgccactgcactccagcctgggcaacaaagcaagaccctgtctcaaaaaatatatattattttctgtatgacatggctgtattaaaaataa

SEQ ID NO: 8294 - DNA, 601 bp, Human
gtgaactgtgattgtgccactgcactccagcctgggcaacaaagcaagaccctgtctcaaaaaatatatattattttctgtatgacatggctgtattaaaaataaatgaataaaatgaggaaagaaatatatagattcatttacacttctaccgtagttttcatgacacctaaatcacagtgccattgctgtggagtcccttgcttgcatttataatccaactcggcctcttatgagctgcctgagttgagtgatttacaaagcttctctaagtctccatttctcagttctaagtgtttartggctccctcattgggtgttttgaagattaaatgaactaaccctttcaaagcacttacagcagagcctggtacacactaaataaatactcaactaattccaatttaggaaatacttattacctactgctatacatcaagcactgttctaggactggggatatgggaatacaaggtaaacgaagaccctgtcctcatagagcttccattctcatggaaggatggagacaaaaaagtgagccatacgtcacatggggacaactgctacagagggaaagggtggtggagagagagaaggtgca

SEQ ID NO: 8295 - DNA, 601 bp, Human
ttccaatttaggaaatacttattacctactgctatacatcaagcactgttctaggactggggatatgggaatacaaggtaaacgaagaccctgtcctcatagagcttccattctcatggaaggatggagacaaaaaagtgagccatacgtcacatggggacaactgctacagagggaaagggtggtggagagagagaaggtgcacagggtttgtgctacagcaactcagataagctggaactgcatttctgaggatccacttacctctatggctctgtgttgggtttgcaagagaaacttkcatgagatttggaaggcagaggtgaagtggcaggtgcgatgttctgaaggttagtgtaggtgctagggtctctcaggtgcattgttgctcaactcaccttgttgacatgggcagcacctgcctgtagctcctcctactcagcctccctgagtcctgcccagcacatgtgcagctttgcagccaagcagcagaaaagacagaaatgaaggcagagaggcagagctacaaggtgctcacaaatacctattttcttctcttcctagacgctcaggtagacccatcttagcccatgcagtgagg

SEQ ID NO: 8296 - DNA, 601 bp, Human
ccacaaaaatgaacataaagaaatgcaggaaacataggaacgagggaaactagaaggtaaaatagcaagaaaatttggggagctgaaaaaaatatataagtaagtgggaaatgacttagaagtgagaaaacagaacctttcatcagagttgaggaaggcagaagtcaagtcttatttacacaacagtattgccaagatggctgagaaagtggaggtggtttaggggagtccgattaagaagaaatggtagaaagttgtttaagaagcaatgaggaacccagatccccttgccactttctgyagatgagcgaccttgacccaccttggcagacaactgggaatgaatgccttagagaggttgcaaagaaggctgggtttctgtgtgtggtagggaaggggtgggcaataggtataggtgaggatggtgacaatgtcctgaaaaccatgggattatgtgaagaacatgtaccagaagctgagaaacactccagccctcttctcctatttggattccagaaagttggcagccagatcttcttcctccagacaagagatggggtgagtcttccctggggatcctgagcagcccaagagagaaggc

SEQ ID NO: 8297 - DNA, 601 bp, Human
gggaaaatcatgcatgaactaattcaagaaattttcctgtgaatttctagatcgaaaaggccactcactgtgcggagcaaagggatggaaatagacacactccaaggctcatccctgtgacattccaggacaccgagaacaaaaagaaaacgctgataaagtgaagacaacagatcacatattgccatagttatcataattgctcctgacttttcaacaacaataggagcaagaaggtaacatagcaatgccttcaaaatcctgaggacaaattgtttccaactcagaattttttatatcwgtcaaactgtcatggtaaaacaggcatttttaaatataaaagttgtcaaaatgtattttccattccccctttctcccgtagttactcaaggatgggttccaccagtacaaaggagtaaacaaagatccaagaatcaagaaaacgttgtagaggagacaaagagaagccccagaaacatgaggaagagacagctgtgtaccaactggtggaggcagtgcatccatacagggcaaaaaaaggctgcaggcatgactttttaggaagatgctcaacaaaatacttgctgagaaaaaaaaaaac

SEQ ID NO: 8298 - DNA, 601 bp, Human
ggcatgactttttaggaagatgctcaacaaaatacttgctgagaaaaaaaaaaacaaaacttagaaatgctggttccaaaacatgtgcttttgtttgtttgttttttcttgttctgacttttaattcattacaccactgctctccaagaaaaggctatcaattattcccttccaacaatgcataagaatgactttttccctacttctccaggacagaatataattatcatttattttaatcttttttgaactgttaaaaagataaactgaggcacagtaaaattttaaagagttttggtgmgttttttttagcatgaacaatttatgaactgagcagctccgaaccagaaatagtttgggagctccactgaggaacacaaagaggagacttttataagacagacacagaagtaaagcaaagtatttaattggttactgttatacaattgctttttttggtctctcaacttggaaagcccctcgttatctaagtttgtataaatagtaacttctgattggttgagcttaagttctgcttttaaaaatatatatatagatatagatatatataggcattcacaagaaatagctcaagttaagt

SEQ ID NO: 8299 - DNA, 601 bp, Human
tgctcaacaaaatacttgctgagaaaaaaaaaaacaaaacttagaaatgctggttccaaaacatgtgcttttgtttgtttgttttttcttgttctgacttttaattcattacaccactgctctccaagaaaaggctatcaattattcccttccaacaatgcataagaatgactttttccctacttctccaggacagaatataattatcatttattttaatcttttttgaactgttaaaaagataaactgaggcacagtaaaattttaaagagttttggtgagttttttttagcatgaacamtttatgaactgagcagctccgaaccagaaatagtttgggagctccactgaggaacacaaagaggagacttttataagacagacacagaagtaaagcaaagtatttaattggttactgttatacaattgctttttttggtctctcaacttggaaagcccctcgttatctaagtttgtataaatagtaacttctgattggttgagcttaagttctgcttttaaaaatatatatatagatatagatatatataggcattcacaagaaatagctcaagttaagtttggttatgtttgcaaatca

SEQ ID NO: 8300 - DNA, 601 bp, Human
actgttaaaaagataaactgaggcacagtaaaattttaaagagttttggtgagttttttttagcatgaacaatttatgaactgagcagctccgaaccagaaatagtttgggagctccactgaggaacacaaagaggagacttttataagacagacacagaagtaaagcaaagtatttaattggttactgttatacaattgctttttttggtctctcaacttggaaagcccctcgttatctaagtttgtataaatagtaacttctgattggttgagcttaagttctgcttttaaaaatatakatatagatatagatatatataggcattcacaagaaatagctcaagttaagtttggttatgtttgcaaatcaagcaaggtttaggtcacttacaaatcataacttcttttgtcccctctgggattcttcaggtctggtctccattttaatttactttaacaatcccaccgctttgggtcaccctctcagcaagctaagaagaaggtggtagcattcctctcagttaccactagtgaaatagtcactggaacaaagagtcatgtaatcttatcctcaacagttgtattgggatataagatta

SEQ ID NO: 8301 - DNA, 601 bp, Human
ccagaaatagtttgggagctccactgaggaacacaaagaggagacttttataagacagacacagaagtaaagcaaagtatttaattggttactgttatacaattgctttttttggtctctcaacttggaaagcccctcgttatctaagtttgtataaatagtaacttctgattggttgagcttaagttctgcttttaaaaatatatatatagatatagatatatataggcattcacaagaaatagctcaagttaagtttggttatgtttgcaaatcaagcaaggtttaggtcacttacaartcataacttcttttgtcccctctgggattcttcaggtctggtctccattttaatttactttaacaatcccaccgctttgggtcaccctctcagcaagctaagaagaaggtggtagcattcctctcagttaccactagtgaaatagtcactggaacaaagagtcatgtaatcttatcctcaacagttgtattgggatataagattacatggcatcattacctgcatcatgggcttcagtggtagggttgttgagttcttcaagtcaattaatgatgatggcaatcatttgatgtgtgagtg

SEQ ID NO: 8302 - DNA, 601 bp, Human
gatgatgggtgctatagttttctattgaaatacaatcttttttatggtcattccaaatttttccaaaaataatcatggttaactcttctttttgtgcaaaatcagtagtctcattaaacttgatctgattatttacataagtgcaacaagaaaagtgattctatgtatgcatatttttaaaatacatcattttgtcaaagttttgataatatccaaggggctttattgactttgtataagtcaatcttagttatttgttcattttattgtttgttttactatttgttaacaaggaatctcmgattagacctttaaaaacctctctaggctaggaggccaagttaaggacttacccaattatgtcttgttataagaacagattcttattgaacctatgcaaatacctatattgccatgaaaataagaatattcaataagtgcttccaaattatggggtgatcaggtagggaggaaaaaaacgttttctttttgtttacaaaagtatattttatcaaattgttttaagttatagaaaaaagttttcctaaatctagaaagcaagacattaaagaaccagcaatgtttcaaacgaaaagttata

SEQ ID NO: 8303 - DNA, 601 bp, Human
tacaattctgtgtcatgcaactgacaagggagtttggttgctttggtaacatacgacattttaacataataattaaaattatggatgataacattatactagtacatatcagatttctaggaatttgacataatttctggaacactcatcaataacaaacataacttaaagaaggtttagcatcacccattatttgacattgcttctcatgcaatttaacatatcaaataagcctcactagtttaacatgtctgtttttacaagaagagaagataaattcttttgagatattccagggacccttttggacactcccaaagttggtttgaggtcaaaaagacctatatggcatggccagttctaggggtaaggttgtgtccatgccagtgtgtggcatatggcgatgttcagctagcatgagtctgaattaattaccacacataggagccagagtaaagtgttcccaggccatctacccccaaccaatgtccccacttattactgcaacctcttacatcttctataacatgctccaaaaagtacgcacaacagtaatcccccaaatgccaaataccacattatttcacgttgaacagtcttg

SEQ ID NO: 8304 - DNA, 601 bp, Human
acaattctgtgtcatgcaactgacaagggagtttggttgctttggtaacatacgacattttaacataataattaaaattatggatgataacattatactagtacatatcagatttctaggaatttgacataatttctggaacactcatcaataacaaacataacttaaagaaggtttagcatcacccattatttgacattgcttctcatgcaatttaacatatcaaataagcctcactagtttaacatgtctgtttttacaagaagagaagataaattcttttgagatattccagggaccmttttggacactcccaaagttggtttgaggtcaaaaagacctatatggcatggccagttctaggggtaaggttgtgtccatgccagtgtgtggcatatggcgatgttcagctagcatgagtctgaattaattaccacacataggagccagagtaaagtgttcccaggccatctacccccaaccaatgtccccacttattactgcaacctcttacatcttctataacatgctccaaaaagtacgcacaacagtaatcccccaaatgccaaataccacattatttcacgttgaacagtcttgt

SEQ ID NO: 8305 - DNA, 601 bp, Human
tccaatggggaacgtcagaggcaccacagccacggaccctccactctctcctgcactcattgcaccttgactgtcttccttggtgcttgcagacgtttgtcatagtggatttttttaatcagatcgtgaattttgggcaaactttctacagttcgtgggagtaaatgtttgaatggtttgagttcagaccgtgagacagatctgcattttccattctgaagaggttacacatgagctagcagatgggatcgaatttcaattatacggaaacaaggtagaaaagaagggacctcaggcaaamgagtaaaagcaagtttgcaacttagagtttacagtggctggtcacaggagtatctgaccctggaattcccaaacttctccgcaccttagaattacctgaggaatatttttaaaatgccaaagcccaggccacacccggaccaattaaattaggcgcactggggtggaatccggcatctgcatttctgaagctccctagatgatcccagcatgcagaggagtctgagaatgactagtctaatttcatttccacaatatgcttgtgaagcggtcgccactatcccctgtgattcccttaagg

SEQ ID NO: 8306 - DNA, 601 bp, Human
accttgactgtcttccttggtgcttgcagacgtttgtcatagtggatttttttaatcagatcgtgaattttgggcaaactttctacagttcgtgggagtaaatgtttgaatggtttgagttcagaccgtgagacagatctgcattttccattctgaagaggttacacatgagctagcagatgggatcgaatttcaattatacggaaacaaggtagaaaagaagggacctcaggcaaaagagtaaaagcaagtttgcaacttagagtttacagtggctggtcacaggagtatctgaccctgkaattcccaaacttctccgcaccttagaattacctgaggaatatttttaaaatgccaaagcccaggccacacccggaccaattaaattaggcgcactggggtggaatccggcatctgcatttctgaagctccctagatgatcccagcatgcagaggagtctgagaatgactagtctaatttcatttccacaatatgcttgtgaagcggtcgccactatcccctgtgattcccttaaggttccccccagtgaatttgtggcatcaggagcccagcccagcactccttccgctgcacgtgccg

SEQ ID NO: 8307 - DNA, 601 bp, Human
agggcgcacagccgagttgagccgtctgattacgctccggggtgatggacaggctgcccctgccccctgctggccagaggctgctattgcagccagcgtgcacacgcgtgcgcgcatcttcagccacctgcagtttctctgattcttccctggtctcctctctgcagtgtcgccagaacaccttcccacactctattctttgtggcccttctgactttctctttgccgtgtgacaggggagtcctccctaaccagcagacagtgaaggtggagtccacgtttctcggcctccacgcatagygagtctcagaccccgcaaggctgcagacagtgctgtgtaagtgggccttcagtcctgtggggagcccaggttgaatccccaggaatagaagctccagaggaaggtccccaatcagtccgtggtccccaatcctgagaagggttgccttttctgggaggagcctgggtctcatcgctatgcgggaacagggctctgggaggtgtccaggaaatgtgagaccggaagtcgccgtcagggaacggagtagtctgtggccctgttagaggaaacagccctggggggtccccaattgcttctaga

SEQ ID NO: 8308 - DNA, 601 bp, Human
attgcagccagcgtgcacacgcgtgcgcgcatcttcagccacctgcagtttctctgattcttccctggtctcctctctgcagtgtcgccagaacaccttcccacactctattctttgtggcccttctgactttctctttgccgtgtgacaggggagtcctccctaaccagcagacagtgaaggtggagtccacgtttctcggcctccacgcatagcgagtctcagaccccgcaaggctgcagacagtgctgtgtaagtgggccttcagtcctgtggggagcccaggttgaatccccaggamtagaagctccagaggaaggtccccaatcagtccgtggtccccaatcctgagaagggttgccttttctgggaggagcctgggtctcatcgctatgcgggaacagggctctgggaggtgtccaggaaatgtgagaccggaagtcgccgtcagggaacggagtagtctgtggccctgttagaggaaacagccctggggggtccccaattgcttctagaatctattctgtttactcttctagggaatacctgtaacttctttccttggaaccaagatttagcacatgagaagaatctggaagaa

SEQ ID NO: 8309 - DNA, 601 bp, Human
aggtgaatagctctggataaacttcagtggccttcttttagatgttttttgtttttgttttttgtgggttttttttccccttgggtcttcctgcctggggccctctgccctgggtctcctgcagaggttcccaccagctcaggaaaacactcaagggtgagtgtctcagagctcaataggcctgagttcctttcccaatacctcctaccactccctggacatacacactagcacatacatgcacacatgtgtgtgcaatcaagctaatcagagtggggccttgattgagtcagagctcttygcactcctccacatgtcctctacagtgtagcactaattctgtgtcctccggggtcagggccaggtgcagcaggtgcaacccacattgcaggtgaaacctgtgagtgaaggagcctggtgggggctcttgctgtcatctaggtggaaggagatgaagatcaggcagaggaggccgaaaaagatctggagggtttggtgacaaaggaaaagatctggagggtctgtgacaatggatttgaaagttctttgtcactttcaagttctacacaaatttgggacagacatcatatgattctagcac

SEQ ID NO: 8310 - DNA, 601 bp, Human
aagggtgagtgtctcagagctcaataggcctgagttcctttcccaatacctcctaccactccctggacatacacactagcacatacatgcacacatgtgtgtgcaatcaagctaatcagagtggggccttgattgagtcagagctctttgcactcctccacatgtcctctacagtgtagcactaattctgtgtcctccggggtcagggccaggtgcagcaggtgcaacccacattgcaggtgaaacctgtgagtgaaggagcctggtgggggctcttgctgtcatctaggtggaaggagaygaagatcaggcagaggaggccgaaaaagatctggagggtttggtgacaaaggaaaagatctggagggtctgtgacaatggatttgaaagttctttgtcactttcaagttctacacaaatttgggacagacatcatatgattctagcaccattgtctcagatttcatagctgtcaaaattttacaatattctacaagaagcaaataaaattaccttgcatctttaagtttagaatttttctttatattttttttccattttgatcattgttaggtttgagccccagccgaggtccaaggga

SEQ ID NO: 8311 - DNA, 601 bp, Human
tattttttttccattttgatcattgttaggtttgagccccagccgaggtccaagggagcaggtggacaggagggcagggagctggaagaatactcaagagacagcaggtagatgagacatggctttattcagcagctcactcacactgtcggtgctgcatttatgcacctcacaaacaatagtggctccaagccaggcgatgagcctctccatgttatggctacatagctgtgtttacattatacaccagactgtgtgcctgtgctacagtcccgctgagtcatgcgggatgtttacctcrgcctatgcctatgtggctgcagctcagccatgttccttacaatcatcataagggtttaaagcattgtttggggaaacccaggcaatctttttttttttttttagacaaaatctcactctgtcacccaggctagagtgcagtggtacaatctcagctcactgcaacctctgccttgtgggttcaagtgattctcccgcctcagcctcccaagtagctgggattacaggcatgcaccaccatgcccagctaatttttgtatttttagtagagacggggtttcaccatgttgatcaggctggt

SEQ ID NO: 8312 - DNA, 601 bp, Human
ccccagccgaggtccaagggagcaggtggacaggagggcagggagctggaagaatactcaagagacagcaggtagatgagacatggctttattcagcagctcactcacactgtcggtgctgcatttatgcacctcacaaacaatagtggctccaagccaggcgatgagcctctccatgttatggctacatagctgtgtttacattatacaccagactgtgtgcctgtgctacagtcccgctgagtcatgcgggatgtttacctcggcctatgcctatgtggctgcagctcagccatgttcyttacaatcatcataagggtttaaagcattgtttggggaaacccaggcaatctttttttttttttttagacaaaatctcactctgtcacccaggctagagtgcagtggtacaatctcagctcactgcaacctctgccttgtgggttcaagtgattctcccgcctcagcctcccaagtagctgggattacaggcatgcaccaccatgcccagctaatttttgtatttttagtagagacggggtttcaccatgttgatcaggctggtctcgaacctctgacctctggtgatccacccgcctcg

SEQ ID NO: 8313 - DNA, 601 bp, Human
tttggggaaacccaggcaatctttttttttttttttagacaaaatctcactctgtcacccaggctagagtgcagtggtacaatctcagctcactgcaacctctgccttgtgggttcaagtgattctcccgcctcagcctcccaagtagctgggattacaggcatgcaccaccatgcccagctaatttttgtatttttagtagagacggggtttcaccatgttgatcaggctggtctcgaacctctgacctctggtgatccacccgcctcggcctcccaaagtgctgggattacaggtgtgrgccactgcgcccagccccaggtaatcattttttgagctgaacttgccctttactttgactctgcaagtgtgctacacttgtagctccttggcaatgaggttgtgaaaacaagtccaacacacacaggataaggatccatcattcttgcatatttagcttaataccaggtgaggctctccactcctctctcatgctcatttccctctccaggctgccatctgctaaggtatgcggtcccctctaggcccaggtcacggagcccgtgcttcacctgctggtgtctcccctcacccagcctcc

SEQ ID NO: 8314 - DNA, 601 bp, Human
atccacccgcctcggcctcccaaagtgctgggattacaggtgtgagccactgcgcccagccccaggtaatcattttttgagctgaacttgccctttactttgactctgcaagtgtgctacacttgtagctccttggcaatgaggttgtgaaaacaagtccaacacacacaggataaggatccatcattcttgcatatttagcttaataccaggtgaggctctccactcctctctcatgctcatttccctctccaggctgccatctgctaaggtatgcggtcccctctaggcccaggtcacrgagcccgtgcttcacctgctggtgtctcccctcacccagcctccagaccccaccaggccagccgtgactgtcaccacctgatcatcttcactcttagacacaagaaaaaacttccaggttttgcatttcaggagttatgactttgggatctctatcccttgcttaagaaacccatgaatttattttttataatttttaccatgccagtgtgggtgggagagtaaaattccccacctcccaaggacatgtttcaggaaataaggaaacgataccagctattatcagatcctgacatttcac

SEQ ID NO: 8315 - DNA, 601 bp, Human
agctccttggcaatgaggttgtgaaaacaagtccaacacacacaggataaggatccatcattcttgcatatttagcttaataccaggtgaggctctccactcctctctcatgctcatttccctctccaggctgccatctgctaaggtatgcggtcccctctaggcccaggtcacggagcccgtgcttcacctgctggtgtctcccctcacccagcctccagaccccaccaggccagccgtgactgtcaccacctgatcatcttcactcttagacacaagaaaaaacttccaggttttgcayttcaggagttatgactttgggatctctatcccttgcttaagaaacccatgaatttattttttataatttttaccatgccagtgtgggtgggagagtaaaattccccacctcccaaggacatgtttcaggaaataaggaaacgataccagctattatcagatcctgacatttcactggggccctggcctgatcttggggacaggagacaggtgcacaccagcccaggccttaagtccactcttcttacttcattcaactcctctctttcttctcctccagctcagagaatctttatttggt

SEQ ID NO: 8316 - DNA, 601 bp, Human
tcaccacctgatcatcttcactcttagacacaagaaaaaacttccaggttttgcatttcaggagttatgactttgggatctctatcccttgcttaagaaacccatgaatttattttttataatttttaccatgccagtgtgggtgggagagtaaaattccccacctcccaaggacatgtttcaggaaataaggaaacgataccagctattatcagatcctgacatttcactggggccctggcctgatcttggggacaggagacaggtgcacaccagcccaggccttaagtccactcttctkacttcattcaactcctctctttcttctcctccagctcagagaatctttatttggtctagggtgttgagggtaagactagaagagctgtttcggttcgcacacatatgggaaaatttctactcaatgtgttgagctacaatttacttaaatacatatatccatatatcaatcatcattatcaagatacagaatgtttgcattacaccaggaagttctttcacatgcctttacaattaatacacttctcccaaatgtctttcaacacgtgaacagataaacagatagcagcacatcacacga

SEQ ID NO: 8317 - DNA, 601 bp, Human
ttttggctactctgtgccctgtgcatgtaagtttcagagtcctcttgtcaatttcaacaaaaatgcctactaggtttgtgtctgtgacgtaacctagtattgagtttatacatcagtttgacaagaattaacatcttaacaatattgagtctcccagttcaggaacatggtatttctctccatttatttagattttctttaatttatcttatcttcctggtgtaatgcaaacattctatatcttgataatgatgattgatacgtggatatatgtatttaagtaaattgtagctcaaaattragtagaaattttcttatatgtgtgtgaaccgacagaaacagctcttctagtcttacccttaacaccctagactaaataaagattttaatttaatttatctcatcaatattttatagttttgaatgtataggtcttgcacatattttgttaaattcatccctaagcatttaatggtttaggatgttgttttaggtgtcattttaaaagttttcatttgtctatggtacactgcaattatatagatagtccatttgagttttctatattgaccttgtaccctgaaacactgctaaatttcag

SEQ ID NO: 8318 - DNA, 601 bp, Human
tatcttcctggtgtaatgcaaacattctatatcttgataatgatgattgatacgtggatatatgtatttaagtaaattgtagctcaaaattaagtagaaattttcttatatgtgtgtgaaccgacagaaacagctcttctagtcttacccttaacaccctagactaaataaagattttaatttaatttatctcatcaatattttatagttttgaatgtataggtcttgcacatattttgttaaattcatccctaagcatttaatggtttaggatgttgttttaggtgtcattttaaaagtwttcatttgtctatggtacactgcaattatatagatagtccatttgagttttctatattgaccttgtaccctgaaacactgctaaatttcagtattggctgttatagctttttgtgtagatcgcttaggatttaatgtgtatacaatcatgttgtctatgaataaagacaatgttccttcttctttacaatatgtatgccctttgtttccctttattgccttatcaagtaattaaatctccagaacaatattaaagaaaagtgctgagagagatagccctgccttttctcctaacttagat

SEQ ID NO: 8319 - DNA, 601 bp, Human
agataccctttattaggaaaaggaagttcctttattttcctagtttgcttatagttctaatttttctaatgttttcctacattttttgatatgaccttatattttgttttctttttaatatcatgaattacactgattgatttttcaaatgttaatccaacctggagttcctgggataaaccccatctggccatgtgtattaccttttttatatactgctaaattcagtacacgaatactgtgttcaggatgttcatgagggacattggtctatcattttcctttcttctaattccttttyctgccttttgtatcaggctgatttgagccttataaaatgaattgagatatgtttctagttttcttaaagagtttaagttcaatattagctttttcttaaatatttatggcattttgtcttgctaaagactatatttctcttgaagttggaggccaagatgacttcactggtaaattctatcaaatatttctatgtctgaaatggttatttttgttataatggattatcgtttattcgaaatgtttaacttaaaattgactatcacattactctatttctgcatagggtttacttttatta

SEQ ID NO: 8320 - DNA, 601 bp, Human
tttattttcctagtttgcttatagttctaatttttctaatgttttcctacattttttgatatgaccttatattttgttttctttttaatatcatgaattacactgattgatttttcaaatgttaatccaacctggagttcctgggataaaccccatctggccatgtgtattaccttttttatatactgctaaattcagtacacgaatactgtgttcaggatgttcatgagggacattggtctatcattttcctttcttctaattccttttcctgccttttgtatcaggctgatttgagccytataaaatgaattgagatatgtttctagttttcttaaagagtttaagttcaatattagctttttcttaaatatttatggcattttgtcttgctaaagactatatttctcttgaagttggaggccaagatgacttcactggtaaattctatcaaatatttctatgtctgaaatggttatttttgttataatggattatcgtttattcgaaatgtttaacttaaaattgactatcacattactctatttctgcatagggtttacttttattataagtttattaggttttctttacctgctta

SEQ ID NO: 8321 - DNA, 601 bp, Human
tgaattacactgattgatttttcaaatgttaatccaacctggagttcctgggataaaccccatctggccatgtgtattaccttttttatatactgctaaattcagtacacgaatactgtgttcaggatgttcatgagggacattggtctatcattttcctttcttctaattccttttcctgccttttgtatcaggctgatttgagccttataaaatgaattgagatatgtttctagttttcttaaagagtttaagttcaatattagctttttcttaaatatttatggcattttgtcttgcyaaagactatatttctcttgaagttggaggccaagatgacttcactggtaaattctatcaaatatttctatgtctgaaatggttatttttgttataatggattatcgtttattcgaaatgtttaacttaaaattgactatcacattactctatttctgcatagggtttacttttattataagtttattaggttttctttacctgcttattaattttctgtctcctgtctgccttctccatcctaccaaacacccttctctgaatatgaatataagctccaagagtgaaggaaacgtgcccg

SEQ ID NO: 8322 - DNA, 601 bp, Human
agtttgtgatcatttgtcacagtagacttggaaaacgaatacaccaactaattaatatttcgattattatgtaattatagaaatatattaattcataggttttctcatatactttatttttataatttccactagtttttcattcctaaaaatatatagatgcattccttttacaaatatttttctagcagcatatttattaattacatttgatttacattttttcacctttctggatggacattcttactcttcagtatttgttcatgttatatattttatacgtgcacatactaaaatrtaaatatgttcttgtaaaatatttaacattttatgcatgttttaatttatgctaattacattgatataaatttattaatttatattacaactaaatacatacatatcataaatgaaaattattagaaataataggagagattgttaatttagatatatataagattcatacacaaaaattagttgcatacatatgaacaaacaacaagcaattacaaaatattatttgataaagacaccacttttggtcaccttttaaaccagaatgcaataattatttaaactttggacttgtcccagt

SEQ ID NO: 8323 - DNA, 601 bp, Human
taattatttaaactttggacttgtcccagtacttactaccaccatttgtcggccctttaaaaaaatgtaactaccagtggattgaagtaaatattcaaattatttctttccaagaaggacattagtttctatcatgtgtaacaccatctggttgtcttcacagaggaaggataatagtgagacttaagagccttggatgatgctgctccttgttctctgtagaaattgatttgttgtcttctgatgtttggtgttgcagcagaaagctctgaagccaatgagacttaaaggaaataacttycttttctctcctgtcctgcacatggtaggatttgtcctagataaatgtggcgggtattgctatcgcagaacatctgtttcccctttatctctggacaaacagaagacttgtgcttttcagctccttgatgatctgcttggctaataaaatatgagtggaagtgacagtcgcacttccaggggaacaatttaaggaccagtgctcaaatttccagcactctcttccccttccgtgacaatcaggcaagcaggcattgatgtgcaagtccataaaagcaatgcacctcaaatcctgagccaa

SEQ ID NO: 8324 - DNA, 601 bp, Human
gaaaggcacaggtgtgagtggcatgaaagaggaacaagcctcacctcccgtattatgtgtctaatggagaatagctaaagctgtaaaacaaacaagtatcaacataaggatacaaatgaaaaatactttaaattgcctccaagaaaagggaattgggatgtagtgttgaagcatagaactgctgcatttttgttagtatgcacttacagcatacaatttttgaagatgtgtatctgcattattttgatgagatgttaatacttgaaagaatactgcaacgatggccaatatacactttttwaattcctagattagaatttcttagtcagagttgatttcttttctaaaatgggttttgattcatctcgccacactgtctttcagaaaggtggtgtcaattgcttttacccagcagaataagcaatcaccttttccctaaaatctcccaactctggttatcatcatttatttcaacttttgtcaatctgatgagaagagtggttttgcacttattttaataatatccgttttgaatacaatttaacattttcattaatatttcttctacagaaaagtgcctgttcctagactcatccccttt

SEQ ID NO: 8325 - DNA, 601 bp, Human
agagtggttttgcacttattttaataatatccgttttgaatacaatttaacattttcattaatatttcttctacagaaaagtgcctgttcctagactcatcccctttttcaattgaaatgttcattttctcttattgtttaaaggacttgcttgtctttatatgaaatttaataaccctttatatgtcaaatagggagaaaacattcacagttgtgatttgtttttaaatttcacttattgtattattctataacatccaagttttagtttgcatgtagtatgatctattatttttccctrtatagtttgtggcattgggatcataaagagaaagctctattccaccaaaaaattagataaattttacttttcttttctttcagatcttctgtgtactgctattttatgtatacatatgtataatcaaaagtcaagcaaacttgattttgtgggtgttgattattaatgacagacattaattggggagatagcatataaaaggtacttctataaatgttgtgaagtgtttactcatttattcccagaacaattatattaggggttcactaatacccattcaagaaagaaggaaactgagac

SEQ ID NO: 8326 - DNA, 601 bp, Human
ggccaacatggtaaaaccccgtctctaccaaaaatacaaaaattagccaggtgtggtggcaggcgcctgtaatcccagcttctcaggaggctgaagcaggagaatcatttgaacccaggaggcggaggttgcggtgaaccgagattgtgtcactgaactcccacctgggcgacagagcaagattccatctcaaaaaataaaaataaaacgctttttaatacaatatttcaaatattatattcattacacaatcaacatatatatgtatatatatataaagactttttattaaaaacaaacmttgcagatgttggtcgaagtgtacaaagtttcagttagacaggatgaataagttctggagatctattatacagcgtgatgactacagttaataataatatattgtgtacttgtaaagtactaagagagggccaggcacggtggctcacacctgtaatcccagcactttgggaggctgaggcgggcagatcatgaggtcaggagatcgagaccctcccggctaacacagtgaaaccccgtttctactaaaaatacaaaaacaaaactgctaaaaatacaaaaacaaaattagccaggcatg

SEQ ID NO: 8327 - DNA, 601 bp, Human
cactaaaaatatacaatttttattggtcagttataccttactaaagctgggtaaagaaacaaatattgcaacagactacagataaagttcccttcaccacttcttccccaacattcatcatagttattgccgcaaaagactgctattattagtttgatgtatagcttttcacaaacagaaaatttctgtttgtacagataagaggtttatgtgcacagacaaaccattttgagttcagtttactgtatataagtgggattataccatacatgtcattctgcagcaattattaaatttaacragatgtttggagatctagctacgtttgcacacaagctgtattcttttttaacctttacatggtgctgtatagaagacgtggaccagaagttatgttattaattcccctgtggagatcattattataaacaatcagtgatgagcgtctttgtaaatctccttttgtgcctgtgtgtgtgtatttctcaaggatgggtgaatccttgaaatggaattgacaagtcaaggaatgcacatattaaacatcttagatccttattatttgcattcagaaatgctgaacagtttctattcccacttt

SEQ ID NO: 8328 - DNA, 601 bp, Human
atccttgaaatggaattgacaagtcaaggaatgcacatattaaacatcttagatccttattatttgcattcagaaatgctgaacagtttctattcccactttgaacataacacccacttctccacacccttgccaagagagtaggacaagcttttaaaatatttgtcaaattaatgaataaatattgcaatttgttttaatctgtaaatatctgatgaataaggagataagacattcttgcaaatatctctgagaatgtttatttcaattattgaaagttgctcatccatttcatgaattwttgacattaattctaaattcaggtgttctgtgtgcttgtattgatggtttaccttcatgctattaatttttctcaaatgtttgagatacttgattgtcaaatagtattaatgcatagatgaattgagggaatattctcatgttggtattttgagctgttgaggcttctacttctgacattctaatttttcttattttgtttttaaccctcagaaatcaaacgtatcggtggccacttttcttgtttaacttggatttatcttttttttatttatttattttcttccatttacaaagatag

SEQ ID NO: 8329 - DNA, 601 bp, Human
acccttgccaagagagtaggacaagcttttaaaatatttgtcaaattaatgaataaatattgcaatttgttttaatctgtaaatatctgatgaataaggagataagacattcttgcaaatatctctgagaatgtttatttcaattattgaaagttgctcatccatttcatgaattattgacattaattctaaattcaggtgttctgtgtgcttgtattgatggtttaccttcatgctattaatttttctcaaatgtttgagatacttgattgtcaaatagtattaatgcatagatgaattsagggaatattctcatgttggtattttgagctgttgaggcttctacttctgacattctaatttttcttattttgtttttaaccctcagaaatcaaacgtatcggtggccacttttcttgtttaacttggatttatcttttttttatttatttattttcttccatttacaaagatagggggctggaagagagaatgccagggggtccagtgggccacaccgaccctttcttccctccatgttccccgttagaatctaagcacagaaggaagaaggcctacttttccagacagtagggccttc

SEQ ID NO: 8330 - DNA, 601 bp, Human
cctttcttccctccatgttccccgttagaatctaagcacagaaggaagaaggcctacttttccagacagtagggccttctcttggcttgcagaagtgcatttgaaatggaggtggcagagatgggataccacaccgggccaggccttgtggaacctgcaatgcattccctgcagagtgatctccagtaggcttcggagagagtaagggctggggccctgtcaagatgctgcacagggagaattcccccaggagctgtccacaggagcccctgagaaggtggaggctgaagggaggagtcarctaagggcagatgtgcagatacgtgtttgagctgggcagcctgaacttggcagaacagagcggggacagaggggagccggagctggccgtggtggtgactgagtgatttagggaaattaaagcaagaggggagatcatggaggaggaagattctcaggttgggcaaagaggctgaactgggtttggtctcccctgtttggggcgttggatcagatgcacagggagtgttccagaggggctggggacagcaatgtgggagggtcccaccacagcagggatttaggtactggtaggtgtctt

SEQ ID NO: 8331 - DNA, 601 bp, Human
ggagctgtgcgcccagactgcagccttgtgtgggcagtagctcaggtccctctgacctctctggcagggaaaaagctgctctgagaccagatgctttgaacctggcatcctgggaccaggaagggccattgttatgggaccattgtcatgggagcaggaataaccctgtcagggcaattgatgactgaaggatcctgctggagctggggcagagagccattggggtcagaggtataagcagacttgttggggttcagggagaagactccttggatctgcaaaaggcaagcctggatgaagrgtaaggaagtgcccatggagaatctctgagcccaggaggagcaccaggtcaggagagaggaggcctgggtgctagtcctggtttggccctgaaatagctgagtgactgtggaaaggctacttgccttctctggacctcatctccctcagttgtgaaatcagcactgagagaaattcccttttgtccctgctacttctggttctatcatgggggaaatttacagctaccccttcacccctgcccagcctagcttagccctgtgctgcgttttggggatcacctccagacctctacggctcc

SEQ ID NO: 8332 - DNA, 601 bp, Human
gagctgtgcgcccagactgcagccttgtgtgggcagtagctcaggtccctctgacctctctggcagggaaaaagctgctctgagaccagatgctttgaacctggcatcctgggaccaggaagggccattgttatgggaccattgtcatgggagcaggaataaccctgtcagggcaattgatgactgaaggatcctgctggagctggggcagagagccattggggtcagaggtataagcagacttgttggggttcagggagaagactccttggatctgcaaaaggcaagcctggatgaagastaaggaagtgcccatggagaatctctgagcccaggaggagcaccaggtcaggagagaggaggcctgggtgctagtcctggtttggccctgaaatagctgagtgactgtggaaaggctacttgccttctctggacctcatctccctcagttgtgaaatcagcactgagagaaattcccttttgtccctgctacttctggttctatcatgggggaaatttacagctaccccttcacccctgcccagcctagcttagccctgtgctgcgttttggggatcacctccagacctctacggctccc

SEQ ID NO: 8333 - DNA, 601 bp, Human; identical to SEQ ID NO: 3187

SEQ ID NO: 8334 - DNA, 601 bp, Human; identical to SEQ ID NO: 3188

SEQ ID NO: 8335 - DNA, 601 bp, Human; identical to SEQ ID NO: 3189

SEQ ID NO: 8336 - DNA, 601 bp, Human; identical to SEQ ID NO: 3190

SEQ ID NO: 8337 - DNA, 601 bp, Human; identical to SEQ ID NO: 3191

SEQ ID NO: 8338 - DNA, 601 bp, Human; identical to SEQ ID NO: 3192

SEQ ID NO: 8339 - DNA, 601 bp, Human; identical to SEQ ID NO: 3193

SEQ ID NO: 8340 - DNA, 601 bp, Human; identical to SEQ ID NO: 3194

SEQ ID NO: 8341 - DNA, 601 bp, Human; identical to SEQ ID NO: 3195

SEQ ID NO: 8342 - DNA, 601 bp, Human; identical to SEQ ID NO: 3196

SEQ ID NO: 8343 - DNA, 601 bp, Human; identical to SEQ ID NO: 3197

SEQ ID NO: 8344 - DNA, 601 bp, Human; identical to SEQ ID NO: 3198

SEQ ID NO: 8345 - DNA, 601 bp, Human; identical to SEQ ID NO: 3199

SEQ ID NO: 8346 - DNA, 601 bp, Human; identical to SEQ ID NO: 3200

SEQ ID NO: 8347 - DNA, 601 bp, Human; identical to SEQ ID NO: 3201

SEQ ID NO: 8348 - DNA, 601 bp, Human; identical to SEQ ID NO: 3202

SEQ ID NO: 8349 - DNA, 601 bp, Human; identical to SEQ ID NO: 3203

SEQ ID NO: 8350 - DNA, 601 bp, Human; identical to SEQ ID NO: 3204

SEQ ID NO: 8351 - DNA, 601 bp, Human; identical to SEQ ID NO: 3205

SEQ ID NO: 8352 - DNA, 601 bp, Human; identical to SEQ ID NO: 3206

SEQ ID NO: 8353 - DNA, 601 bp, Human; identical to SEQ ID NO: 3207

SEQ ID NO: 8354 - DNA, 601 bp, Human; identical to SEQ ID NO: 3208

SEQ ID NO: 8355 - DNA, 601 bp, Human; identical to SEQ ID NO: 3209

SEQ ID NO: 8356 - DNA, 601 bp, Human; identical to SEQ ID NO: 3210

SEQ ID NO: 8357 - DNA, 601 bp, Human; identical to SEQ ID NO: 3211

SEQ ID NO: 8358 - DNA, 601 bp, Human; identical to SEQ ID NO: 3212

SEQ ID NO: 8359 - DNA, 601 bp, Human; identical to SEQ ID NO: 3213

SEQ ID NO: 8360 - DNA, 601 bp, Human; identical to SEQ ID NO: 3214

SEQ ID NO: 8361 - DNA, 601 bp, Human; identical to SEQ ID NO: 2058

SEQ ID NO: 8362 - DNA, 601 bp, Human
cctttccatggtgactattctgatgtttttgaaatataaaatattaggccgggcaaggtggctcatgcctgtagtcccaacactttgggaggccgaggcaggtcgatcacctgagggcaggagaccagcctgaccaatatggtgagaccctgtctctactaaaaatacaaaaattagccaggcgtggtggcaggcgcctgtaatcccagctactcgggaggctgaggcaggagaactgcttgaacctgggaggcagaagttatggtgagccaagatccagcctgggctccagcctgggcarcagagcaagactctgtctcaaaaaataaaataaaataaaatgaaatataaaatattaaaatctgtccaaaaacgtgttccttgctggtaccctacacattgtggcctgcttcctgggtgatctggccccaggtgggatgctaatcccaagtcccctcccagcacagcctcagcccatctttcagggagaactcagctaccaggagcctttcatccacataagcttgatgcccatccaattctccggccaacctcctgagcaggggcaggagacccatgggaagtctgctcagatcactag

SEQ ID NO: 8363 - DNA, 601 bp, Human
attcttggtaatgggagatcaaagccacaagccataaaaagagtgagactctctccacaccccacatgtaactaaaaacagagaagtctaaattgtaaaataaaaggaagttcaacaaactgttgacctttccatggtgactattctgatgtttttgaaatataaaatattaggccgggcaaggtggctcatgcctgtagtcccaacactttgggaggccgaggcaggtcgatcacctgagggcaggagaccagcctgaccaatatggtgagaccctgtctctactaaaaatacaaaaatyagccaggcgtggtggcaggcgcctgtaatcccagctactcgggaggctgaggcaggagaactgcttgaacctgggaggcagaagttatggtgagccaagatccagcctgggctccagcctgggcagcagagcaagactctgtctcaaaaaataaaataaaataaaatgaaatataaaatattaaaatctgtccaaaaacgtgttccttgctggtaccctacacattgtggcctgcttcctgggtgatctggccccaggtgggatgctaatcccaagtcccctcccagcacagcctcagcc

SEQ ID NO: 8364 - DNA, 601 bp, Human
atccgtgtgtgtgcatccgtgtgtgtgcatccgtgtgtgcatccctgtgtgtgcgtgtgtgcatccgtgtgtgcatctgtgtgtgtgcatccgtgtgtgcatccatgtgcgcgtgtgtgcgtgtgcatccgtgtgtgcatctgtgtgtgcatccgtgtttgtgcatccctgtgtatgcatccgtgtgtgtgcatccctgtgtgtgtgcatccgtgtgtgtgtgcatccatgtgtgtgcatccgtgtgtgtgtgtgtgcatccgtgtgtgtgtgtgtgtgtgtgtgtgtgtgtgtgtgtgttgtggggtagttcgctgtatttgctgggctttccctgagagccagctggtgcccaggtctgccaggcctggctcagcttgtttcctcagactggactcgccccaggcccaacagtttgcctttgagctgcgcctccatcaggaaaccacctcctgttgcatttcccaccaggactcagaaaacagcattgtcttggtagatggtcttgagttcaaatcctcactgccttggagtcactgaaggaccctgggcttggcacctcgcttccgtctcccctctgggacatggggctgtgcagatc

SEQ ID NO: 8365 - DNA, 601 bp, Human
catccgtgtgtgtgcatccgtgtgtgtgcatccgtgtgtgcatccctgtgtgtgcgtgtgtgcatccgtgtgtgcatctgtgtgtgtgcatccgtgtgtgcatccatgtgcgcgtgtgtgcgtgtgcatccgtgtgtgcatctgtgtgtgcatccgtgtttgtgcatccctgtgtatgcatccgtgtgtgtgcatccctgtgtgtgtgcatccgtgtgtgtgtgcatccatgtgtgtgcatccgtgtgtgtgtgtgtgcatccgtgtgtgtgtgtgtgtgtgtgtgtgtgtgtgtgtgtgtggtggggtagttcgctgtatttgctgggctttccctgagagccagctggtgcccaggtctgccaggcctggctcagcttgtttcctcagactggactcgccccaggcccaacagtttgcctttgagctgcgcctccatcaggaaaccacctcctgttgcatttcccaccaggactcagaaaacagcattgtcttggtagatggtcttgagttcaaatcctcactgccttggagtcactgaaggaccctgggcttggcacctcgcttccgtctcccctctgggacatggggctgtgcagat

SEQ ID NO: 8366 - DNA, 601 bp, Human
tgcgcatccgtgtgtgtgcatccgtgtgtgtgcatccgtgtgtgcatccctgtgtgtgcgtgtgtgcatccgtgtgtgcatctgtgtgtgtgcatccgtgtgtgcatccatgtgcgcgtgtgtgcgtgtgcatccgtgtgtgcatctgtgtgtgcatccgtgtttgtgcatccctgtgtatgcatccgtgtgtgtgcatccctgtgtgtgtgcatccgtgtgtgtgtgcatccatgtgtgtgcatccgtgtgtgtgtgtgtgcatccgtgtgtgtgtgtgtgtgtgtgtgtgtgtgtgtgtgtgtggtggggtagttcgctgtatttgctgggctttccctgagagccagctggtgcccaggtctgccaggcctggctcagcttgtttcctcagactggactcgccccaggcccaacagtttgcctttgagctgcgcctccatcaggaaaccacctcctgttgcatttcccaccaggactcagaaaacagcattgtcttggtagatggtcttgagttcaaatcctcactgccttggagtcactgaaggaccctgggcttggcacctcgcttccgtctcccctctgggacatggggctgtgc

SEQ ID NO: 8367 - DNA, 601 bp, Human
agatggctctgaggccaggctctggatctctcatccctgcatttaaggccatttccctgagtctggcacaaagtagatatctatatttaattttattttatttatgtatttattttttgagatggagtctggccctgttgcccaggctggagggcagtggcgcgatctcggctcactgcagcctctgcctcccgggttcaagcgattctcctgcctcggcctcctgagtagctgggattataggcacgcaccaccacacctggataatttttgtatttttagtagaggtggggtttcaccrtattgcccaggctggtattgaactcctcaggtgatccgcccgccttggcctcccaaagtgctgggattacacgcgtgagccaccgcgcccggcctgatatctatattttattcctttttcttcacatctctgcctcgcctggaatgatttgtggtgattcataaaaatacataatacaggtaagataaaactcgcttaaaataatggggcaggcaaaaaagaacagaaggaaaatgatggtttaaaaaaagagggggatacaacaagccaggaaggaggccaacagctaacatgtagatc

SEQ ID NO: 8368 - DNA, 601 bp, Human
gcacagtggctcaggcctgtaatcccagcattttgggaggccgacatgggtggatcacctgaggtcaggagttcaagaccagcccagccaacacagtgaaaccctatctctactaaaaatacaaaaattagctgggcgtggtggcgcatgcctgtagtcctagctgcttgggaggctgaggcaggagactcgcttgaacctgggaggcggaggttgcagtgagccgagatcgcaccactgcactccagcctggtgatagagcaagactccgtctcaaacaaacacacacacacacacacacaaaagaaaaagaggtgaaataactgcaggaagtggggcaaaatcctcacaactgcttagagtgtgctcgccacagaactgaaacctgacgttaaacttccagttttcaggcagtttggggaataaaaagacaaatcacaccaagaggaagcaaacacacaaatcctgaacatagatattctgcaacacacgtgaccaaactctgccataaatcaaaggcatgaaagcagaaaatggggatgggggtgcactccagacggagagccacagcaaccgcatgtcatgtgcggaccttgtttgg

SEQ ID NO: 8369 - DNA, 601 bp, Human
aggcacagtggctcaggcctgtaatcccagcattttgggaggccgacatgggtggatcacctgaggtcaggagttcaagaccagcccagccaacacagtgaaaccctatctctactaaaaatacaaaaattagctgggcgtggtggcgcatgcctgtagtcctagctgcttgggaggctgaggcaggagactcgcttgaacctgggaggcggaggttgcagtgagccgagatcgcaccactgcactccagcctggtgatagagcaagactccgtctcaaacaaacacacacacacacacacacaaaagaaaaagaggtgaaataactgcaggaagtggggcaaaatcctcacaactgcttagagtgtgctcgccacagaactgaaacctgacgttaaacttccagttttcaggcagtttggggaataaaaagacaaatcacaccaagaggaagcaaacacacaaatcctgaacatagatattctgcaacacacgtgaccaaactctgccataaatcaaaggcatgaaagcagaaaatggggatgggggtgcactccagacggagagccacagcaaccgcatgtcatgtgcggaccttgttt

SEQ ID NO: 8370 - DNA, 601 bp, Human
ccaggcacagtggctcaggcctgtaatcccagcattttgggaggccgacatgggtggatcacctgaggtcaggagttcaagaccagcccagccaacacagtgaaaccctatctctactaaaaatacaaaaattagctgggcgtggtggcgcatgcctgtagtcctagctgcttgggaggctgaggcaggagactcgcttgaacctgggaggcggaggttgcagtgagccgagatcgcaccactgcactccagcctggtgatagagcaagactccgtctcaaacaaacacacacacacacamacacaaaagaaaaagaggtgaaataactgcaggaagtggggcaaaatcctcacaactgcttagagtgtgctcgccacagaactgaaacctgacgttaaacttccagttttcaggcagtttggggaataaaaagacaaatcacaccaagaggaagcaaacacacaaatcctgaacatagatattctgcaacacacgtgaccaaactctgccataaatcaaaggcatgaaagcagaaaatggggatgggggtgcactccagacggagagccacagcaaccgcatgtcatgtgcggaccttgt

SEQ ID NO: 8371 - DNA, 601 bp, Human
tttatttttcatttgttcatctggcccttataaaaatggcatgaaaaacgtcttttttatggataaattattactaataaatgtaggaagaataatagaaccaaactattttgtgagccctaatgaaatacaataattaattcaggccaggatcatcaacaggtaaagcttctaaatgagagtctgatagactaactttacaattaggctgacaccacctgagcccactagtcaatcttagcatccctaggagtgggcctctcaggcatgtccttcttggtgtgacactctaggaaggatstaagggcccaagactacatttccaacaagattctaagggacacccacactgcaggtcttcagaccacattctgagtaccaaggctttaaaacacttcagcaaagaaaagaaaaagaagggccaggcacagtggctcaggcctgtaatcccagcattttgggaggccgacatgggtggatcacctgaggtcaggagttcaagaccagcccagccaacacagtgaaaccctatctctactaaaaatacaaaaattagctgggcgtggtggcgcatgcctgtagtcctagctgcttgggaggc

SEQ ID NO: 8372 - DNA, 601 bp, Human
aattttgtatttttggtagagatggagtttcactctgttggccaggctggtcttgaactcctgatctcaagtaatctgcccccacttggcctctcaaatgctgggatttcaggcgtgagccacctcacccagccttaaatttatttttcatttgttcatctggcccttataaaaatggcatgaaaaacgtcttttttatggataaattattactaataaatgtaggaagaataatagaaccaaactattttgtgagccctaatgaaatacaataattaattcaggccaggatcatcaacaggtaaagcttctaaatgagagtctgatagactaactttacaattaggctgacaccacctgagcccactagtcaatcttagcatccctaggagtgggcctctcaggcatgtccttcttggtgtgacactctaggaaggatgtaagggcccaagactacatttccaacaagattctaagggacacccacactgcaggtcttcagaccacattctgagtaccaaggctttaaaacacttcagcaaagaaaagaaaaagaagggccaggcacagtggctcaggcctgtaatcccagcattttggg

SEQ ID NO: 8373 - DNA, 601 bp, Human
tatgtcgattgagatggctgaagattctatgattctgaagtcgatgagcgcacagcctatttccatgtgtttggaagtgcttttgggttcagtatttattttgccctcaaggtgtttctctgtaacttttgctatgactttattttttatttttatttttttgagatggagtctcactctgtcgcccaagctggagtgcggtggcgcgatcttggctcaccgcaacctctggctcttgggttcaagcaattctcctgcctcagtctccggagtagctgggattacaggcgcccgccaccaygcccagctaagttttgtattattagtagagacgaggtttcaccatgttggccaggctggtctcatactcgtcctgacctcaagagatccgcccgcctcagcctcccaaagtgctgggattacaggcgtgagccaccgcgcctagcccccactgtcaaatcttgtcttctccttttaatgaggccaataaaccttcatgacaatacattttatacggaaactgtatttttatattcaaagtattgtttttatttatctaaacttgttttattggtcaattaatacattttcctaacagtaa

SEQ ID NO: 8374 - DNA, 601 bp, Human
ttttgctgatgtatgtcgattgagatggctgaagattctatgattctgaagtcgatgagcgcacagcctatttccatgtgtttggaagtgcttttgggttcagtatttattttgccctcaaggtgtttctctgtaacttttgctatgactttattttttatttttatttttttgagatggagtctcactctgtcgcccaagctggagtgcggtggcgcgatcttggctcaccgcaacctctggctcttgggttcaagcaattctcctgcctcagtctccggagtagctgggattacaggcrcccgccaccatgcccagctaagttttgtattattagtagagacgaggtttcaccatgttggccaggctggtctcatactcgtcctgacctcaagagatccgcccgcctcagcctcccaaagtgctgggattacaggcgtgagccaccgcgcctagcccccactgtcaaatcttgtcttctccttttaatgaggccaataaaccttcatgacaatacattttatacggaaactgtatttttatattcaaagtattgtttttatttatctaaacttgttttattggtcaattaatacatttt

SEQ ID NO: 8375 - DNA, 601 bp, Human
agtccaacaatatcatatggaacaaatctgcgttgcatgtcatgtttggataaatcccatatgcctgcttttgctgatgtatgtcgattgagatggctgaagattctatgattctgaagtcgatgagcgcacagcctatttccatgtgtttggaagtgcttttgggttcagtatttattttgccctcaaggtgtttctctgtaacttttgctatgactttattttttatttttatttttttgagatggagtctcactctgtcgcccaagctggagtgcggtggcgcgatcttggctcacckcaacctctggctcttgggttcaagcaattctcctgcctcagtctccggagtagctgggattacaggcgcccgccaccatgcccagctaagttttgtattattagtagagacgaggtttcaccatgttggccaggctggtctcatactcgtcctgacctcaagagatccgcccgcctcagcctcccaaagtgctgggattacaggcgtgagccaccgcgcctagcccccactgtcaaatcttgtcttctccttttaatgaggccaataaaccttcatgacaatacattttatacggaaact

SEQ ID NO: 8376 - DNA, 601 bp, Human
acaccaccacccccagctaatttttgtatttttagtagagataggttttcaccgtgttggccaggctggtctcaaactcctgatctcaggtgattcagccgttcaacgtgctgggattacaggtgtgagccactgctcccatctctaatctacatttgcatgggaaaaaagcaaggtgaattccagtttacagatttacctgttcaattactgttcaattaacgacttttgccataaacactcttgaaaagctatacaacttcttggcaacactcctttttttggtttagtgactttttcrtctctaaatacactgagtaaacacgatataaggaatgacatttgacatcgcactctcacgggaagacacactcacccatttacttactatgtaacagtttctagtccaacaatatcatatggaacaaatctgcgttgcatgtcatgtttggataaatcccatatgcctgcttttgctgatgtatgtcgattgagatggctgaagattctatgattctgaagtcgatgagcgcacagcctatttccatgtgtttggaagtgcttttgggttcagtatttattttgccctcaaggtgtttct

SEQ ID NO: 8377 - DNA, 601 bp, Human
ccgagctagagtacaatggtgcaatctcagctcactgacaccttcgcctcccaggatcaagcgattctcctgcctcagcctcccaagtagccgggattacaggtacacaccaccacccccagctaatttttgtatttttagtagagataggttttcaccgtgttggccaggctggtctcaaactcctgatctcaggtgattcagccgttcaacgtgctgggattacaggtgtgagccactgctcccatctctaatctacatttgcatgggaaaaaagcaaggtgaattccagtttacagayttacctgttcaattactgttcaattaacgacttttgccataaacactcttgaaaagctatacaacttcttggcaacactcctttttttggtttagtgactttttcgtctctaaatacactgagtaaacacgatataaggaatgacatttgacatcgcactctcacgggaagacacactcacccatttacttactatgtaacagtttctagtccaacaatatcatatggaacaaatctgcgttgcatgtcatgtttggataaatcccatatgcctgcttttgctgatgtatgtcgattgag

SEQ ID NO: 8378 - DNA, 601 bp, Human
ttcgctcttgtcgcccgagctagagtacaatggtgcaatctcagctcactgacaccttcgcctcccaggatcaagcgattctcctgcctcagcctcccaagtagccgggattacaggtacacaccaccacccccagctaatttttgtatttttagtagagataggttttcaccgtgttggccaggctggtctcaaactcctgatctcaggtgattcagccgttcaacgtgctgggattacaggtgtgagccactgctcccatctctaatctacatttgcatgggaaaaaagcaaggtgaaktccagtttacagatttacctgttcaattactgttcaattaacgacttttgccataaacactcttgaaaagctatacaacttcttggcaacactcctttttttggtttagtgactttttcgtctctaaatacactgagtaaacacgatataaggaatgacatttgacatcgcactctcacgggaagacacactcacccatttacttactatgtaacagtttctagtccaacaatatcatatggaacaaatctgcgttgcatgtcatgtttggataaatcccatatgcctgcttttgctgat

SEQ ID NO: 8379 - DNA, 601 bp, Human
cttttttttttttgagatggagtttcgctcttgtcgcccgagctagagtacaatggtgcaatctcagctcactgacaccttcgcctcccaggatcaagcgattctcctgcctcagcctcccaagtagccgggattacaggtacacaccaccacccccagctaatttttgtatttttagtagagataggttttcaccgtgttggccaggctggtctcaaactcctgatctcaggtgattcagccgttcaacgtgctgggattacaggtgtgagccactgctcccatctctaatctacatttrcatgggaaaaaagcaaggtgaattccagtttacagatttacctgttcaattactgttcaattaacgacttttgccataaacactcttgaaaagctatacaacttcttggcaacactcctttttttggtttagtgactttttcgtctctaaatacactgagtaaacacgatataaggaatgacatttgacatcgcactctcacgggaagacacactcacccatttacttactatgtaacagtttctagtccaacaatatcatatggaacaaatctgcgttgcatgtcatgtttggataaat

SEQ ID NO: 8380 - DNA, 601 bp, Human
aaggtttatctcccccagtgttgcctggactgactgtgaagacattttcatccttgttttaagagtatatcatcatcttgttccaaaattattattatttttttaagatggagtttcgctcttgttgcccaggctggagtgcagtggcacgatctcggctcaccgcaacctctgcctcccaggttcaagcgattctcctgcctcagcctcccgagtagctgggattacaggcatgtgccaccatgcccggctaatttttggtttttttgtttgtttgtttatttgttttttttttttttttggaaatggagtcacactctgtcacccaggctggagcgcagaggcgagatctcagctcactgcaagctttgcctcccaggttcacaccattctcctgcctcagcctcctgagtagctgtgactacaggcgcctgcccggctaattttttgtatttttagtagagagggggtttcaccgtgttaagccaggttggtctcgatctcctgacctcgtgatccgcccacctcggcctcccaaagtgctgggattacaggcgtgagccaccgcgcctggcctaattttgtatttttagtagagatg

SEQ ID NO: 8381 - DNA, 601 bp, Human
aacctatagtaaaaaaaaaaaaatgcttgagaggatgggactaactgggaagggactagaaggaactttctggaatgatgaaaatattctatatcttgataggtgtttgaattaccaaggtgtgcatgtgtcagaacacacgcaatgaatggtccacttagaatttgtgcatgtcactgtatgtaaatattaccttaaagaagaagcacaaacacattttgttgatatgtatgctgaaatgtttagagttgaattatacttaagtcagcaatttatttttattaatttcttttttttttttgagatggggtcttgctctgtcgcccaggctggagtgcagtggtgcaatcttggctcactacaacttctgtgtcccgggttcaagcgattctcctgtctcagcctcccacatagctgggattacaggcgcctgccaccatgcccggctaattttttgtatttttagtagagacagggtttcacaatgttgaccgagctggtttcgaactcctgacctcaagtgatccacctgccttggcctcccaaagtgctgggattacaggtgtgagccaccacatccagcgtgcaatttactttaaaa

SEQ ID NO: 8382 - DNA, 601 bp, Human
ggccctactcaccaggtctggttggtgctggggtcttggtgcagaagggagctgagcacgaaaggggcacctcccttgggcgtgagccagggccgggccacatccacattgaaagcggccagcagggccaggcctgtagggaaaagaggagcgtttaatgaaagaggccttttactcccgttattccagcaaatcctgtggtgtcatgaaccccgttttacagctgagaaaagtgagactgcccagggatctttatgtgtgtgtgagagagaaagactagacgcaggtgtatctgacccasagcctctgatcctcctactaaaccaagctgtaccagtacccgagcccccctcctccaagaagccgcccctagctctccccaaagaagcacttcccacctcctcacgcctcttactgtcatttctgcacctgacacacagcgtgtactcacgtcactgcgtcttgtactgaagttacagtagactgtgagccccaggaagagggcctgtgtatgttctatgtacccccttcaagcgacccacgagaaaacgtatccccaaaactgcctgcacaagaatgttttataccagctttattcgga

SEQ ID NO: 8383 - DNA, 601 bp, Human
attgtcttttttttttttttttgagacggagtctcgctctgtcgcccaggctggagtgcagtggcgccatctcggttcactgcaagctccgcctcccgggttcacgccattctcctgcctcagcctcctgagtagctgggactacaggcgcccgcctcctcgcctggctaattttttctattttttagtagagacagggtttcaccgtgttagccaggatggtctcaatctcctgacctcgtgatccgcccgcctcggcctcccaaagtgctgggattacaggcgtgagccaccgtgcccrgccactaaaattgtctttaagtccaccctccccctgggcaatggagcagggagaggcccagtgaggcgtgaggctggggttccgtggaccccacagaccagcccgatgcccacagcctctctcacaccttctctctttctcctgcatgcccttctgaaagagaaaggagttcctctcctgacggtggggtggggtgggctgccatggccgtctctggggcccatctcagattgcctggaagcccctcagtctgaaggcctcttgcccaccggccctactcaccaggtctggttggtgctg

SEQ ID NO: 8384 - DNA, 601 bp, Human
aagtagctgagactacaggcaggcaccaccatgcccagacagtttttggttttttttgagttgggggggtctcactatgttgcccagggtggtcttgaactcctggcctcaagaaatcctccagcttcagcctccctaagtgttgagattacaggcgtgagccacggtgccaggcccagttttttctttgttattttttgtttccaaatgttctatattgaacatgtgttacttccataaggaacaaaagagccttaatatgctttattttaaaattgtcttttttttttttttttgagayggagtctcgctctgtcgcccaggctggagtgcagtggcgccatctcggttcactgcaagctccgcctcccgggttcacgccattctcctgcctcagcctcctgagtagctgggactacaggcgcccgcctcctcgcctggctaattttttctattttttagtagagacagggtttcaccgtgttagccaggatggtctcaatctcctgacctcgtgatccgcccgcctcggcctcccaaagtgctgggattacaggcgtgagccaccgtgcccggccactaaaattgtctttaagtccac

SEQ ID NO: 8385 - DNA, 601 bp, Human
ggaaactgaagctcaggcccgagcaccttgctcaggctatgcggcaaatccacggtgaagctgccactgaaccctggctgccagagccacagcctgcctcttaccagtacacgcttgttcctcatagtttcagggtttttgttctggagacaggccggagtgcagtggtgcaatcacggctccctacagcctcggcctccgggcccaagtggtcctcctgcctcagcctcccaagtagctgagactacaggcaggcaccaccatgcccagacagtttttggttttttttgagttgggggggtctcactatgttgcccagggtggtcttgaactcctggcctcaagaaatcctccagcttcagcctccctaagtgttgagattacaggcgtgagccacggtgccaggcccagttttttctttgttattttttgtttccaaatgttctatattgaacatgtgttacttccataaggaacaaaagagccttaatatgctttattttaaaattgtcttttttttttttttttgagacggagtctcgctctgtcgcccaggctggagtgcagtggcgccatctcggttcactgcaagctccgcctc

SEQ ID NO: 8386 - DNA, 601 bp, Human
ggctcactgcaacctccacctcccaggttcaagcaattctcctgcctcagcctcccgagtagctgggactacgcgcgtgtaccaccacgcccagataatttttgtatttttagtagagacggggtttcaccatgttggccaggctggtctccaactcctgacctcaaatgatccgcccgcctcggcctcccaaagtgctgggattacaggcgtgagccaccgcgcccggcagaacctgtgctaagccctttacatgcattatctcaaatagtctttgcgacaatcctgtgaagtaggtagwtccccacgctgactgcagagaagggaaactgaagctcaggcccgagcaccttgctcaggctatgcggcaaatccacggtgaagctgccactgaaccctggctgccagagccacagcctgcctcttaccagtacacgcttgttcctcatagtttcagggtttttgttctggagacaggccggagtgcagtggtgcaatcacggctccctacagcctcggcctccgggcccaagtggtcctcctgcctcagcctcccaagtagctgagactacaggcaggcaccaccatgcccagacagttt

SEQ ID NO: 8387 - DNA, 601 bp, Human
cggagtcttgctctgtcgcccaggctgtagtgcaatggcacgatcttggctcactgcaacctccacctcccaggttcaagcaattctcctgcctcagcctcccgagtagctgggactacgcgcgtgtaccaccacgcccagataatttttgtatttttagtagagacggggtttcaccatgttggccaggctggtctccaactcctgacctcaaatgatccgcccgcctcggcctcccaaagtgctgggattacaggcgtgagccaccgcgcccggcagaacctgtgctaagccctttacrtgcattatctcaaatagtctttgcgacaatcctgtgaagtaggtagttccccacgctgactgcagagaagggaaactgaagctcaggcccgagcaccttgctcaggctatgcggcaaatccacggtgaagctgccactgaaccctggctgccagagccacagcctgcctcttaccagtacacgcttgttcctcatagtttcagggtttttgttctggagacaggccggagtgcagtggtgcaatcacggctccctacagcctcggcctccgggcccaagtggtcctcctgcctcagcctc

SEQ ID NO: 8388 - DNA, 601 bp, Human
tcccccgtcaactcattaacaaagaaaaagacatttattactttggagattccagagattttaggcatgtatgccagataatgggaccaaatgtttattttgagaccaaatatatttttatttgttatattgtaaaatatatattcagtcttggaatgtcaaatatacatttcacagtatcacaggatccaagtctgcctggctgtcagggtcaaggcccaagtcccagggcctatgaggctgcttcgggagccaccactgcccacccatcctattcaagcaaagctcccgccctgcccasccaggaaccctggctcctcacctggctctgccccagtgcctgtttgaaccctgggctcacttgctcctgtgtgctgggtgtgaaggaaacccttgaccactgaccaggagcaaagcaatctggtgggctggggtgggatgaggaggtaaccatcctaggctgggcccgctcagtgggagagtatgcacaagaaaagccctatgaccacccagaaaaaaatgggggagaaatcactgctttggattgaaatcaatgacagagacataacagcaatacgtaatacataaaccttgaccagat

SEQ ID NO: 8389 - DNA, 601 bp, Human
aaacttccacatgttctgctacccagaagctccccaaaccctgtccttttgagttttatggaggcctcattacataggcatgactcattgaatcactggccgctggtgatcaactaaaccttcagcccttctctcccagaagaggggtgtggggctgaaagtcccaaccctctgatcgtgcctggttctctccagtgaccagcccccattttgaagctatctgggggctgccggtcccccgtcaactcattaacaaagaaaaagacatttattactttggagattccagagattttaggcrtgtatgccagataatgggaccaaatgtttattttgagaccaaatatatttttatttgttatattgtaaaatatatattcagtcttggaatgtcaaatatacatttcacagtatcacaggatccaagtctgcctggctgtcagggtcaaggcccaagtcccagggcctatgaggctgcttcgggagccaccactgcccacccatcctattcaagcaaagctcccgccctgcccagccaggaaccctggctcctcacctggctctgccccagtgcctgtttgaaccctgggctcacttgctc

SEQ ID NO: 8390 - DNA, 601 bp, Human
tcgcttgaacccagtggttgcagtgagccgagagcatgccaccacactccagcctgggtggcagagcaagactctgcctcaaaaagaaaaaaaaaagatattacaaaggatacagatgaggagatgcataaggcaaagtgggggtgaggggcaaagtgggggtgaggggcaaagcttccatgccctctcgggggccaccctccagaaacttccacatgttctgctacccagaagctccccaaaccctgtccttttgagttttatggaggcctcattacataggcatgactcattgaatcaytggccgctggtgatcaactaaaccttcagcccttctctcccagaagaggggtgtggggctgaaagtcccaaccctctgatcgtgcctggttctctccagtgaccagcccccattttgaagctatctgggggctgccggtcccccgtcaactcattaacaaagaaaaagacatttattactttggagattccagagattttaggcatgtatgccagataatgggaccaaatgtttattttgagaccaaatatatttttatttgttatattgtaaaatatatattcagtcttggaatgtcaa

SEQ ID NO: 8391 - DNA, 601 bp, Human
ggcaggagaatcgcttgaacccagtggttgcagtgagccgagagcatgccaccacactccagcctgggtggcagagcaagactctgcctcaaaaagaaaaaaaaaagatattacaaaggatacagatgaggagatgcataaggcaaagtgggggtgaggggcaaagtgggggtgaggggcaaagcttccatgccctctcgggggccaccctccagaaacttccacatgttctgctacccagaagctccccaaaccctgtccttttgagttttatggaggcctcattacataggcatgactsattgaatcactggccgctggtgatcaactaaaccttcagcccttctctcccagaagaggggtgtggggctgaaagtcccaaccctctgatcgtgcctggttctctccagtgaccagcccccattttgaagctatctgggggctgccggtcccccgtcaactcattaacaaagaaaaagacatttattactttggagattccagagattttaggcatgtatgccagataatgggaccaaatgtttattttgagaccaaatatatttttatttgttatattgtaaaatatatattcagtctt

SEQ ID NO: 8392 - DNA, 601 bp, Human
tacctcggacgtcccccaacagagctgttattcggtggggtcattgtcactcttgtcatcgtctagcttgtgtttccctcatgagcccgggagctccatgaaggcagtgaccatgtctccctcttattccccaaatattgcctggcactgagtaagtgctccatccatacttgctgaatgaatgaatgaatgaatgaatgaattggccccatccttaccacttaaatctaatggtgagcagacttttttttttttttttgagacggagtctcactgtcgcccaggctggagtgcagtggcrcgatctcggctcactgcaagctccgcctcccgcgttcatgccattctcctgcctcagcctcccaagcagctgggactacaggtgcgcgccaccacgcccagataatttttgtatttttagtagggacaaggcttcagcatattggccaggctgatctcaaactcctgacctcaaatgatctgcccgcctcagcctcccaaagtgctgggattacaggcgtgagccaccgcgcctggcagtgaccagacttttgactgcaccgatgaaaccaggatccagaaaggactctctaatgatgta

SEQ ID NO: 8393 - DNA, 601 bp, Human
aacacacctgcctcgatgcgcccccccgtacctcggacgtcccccaacagagctgttattcggtggggtcattgtcactcttgtcatcgtctagcttgtgtttccctcatgagcccgggagctccatgaaggcagtgaccatgtctccctcttattccccaaatattgcctggcactgagtaagtgctccatccatacttgctgaatgaatgaatgaatgaatgaatgaattggccccatccttaccacttaaatctaatggtgagcagacttttttttttttttttgagacggagtctcwctgtcgcccaggctggagtgcagtggcgcgatctcggctcactgcaagctccgcctcccgcgttcatgccattctcctgcctcagcctcccaagcagctgggactacaggtgcgcgccaccacgcccagataatttttgtatttttagtagggacaaggcttcagcatattggccaggctgatctcaaactcctgacctcaaatgatctgcccgcctcagcctcccaaagtgctgggattacaggcgtgagccaccgcgcctggcagtgaccagacttttgactgcaccgatgaaaccag

SEQ ID NO: 8394 - DNA, 601 bp, Human
gaacacacctgcctcgatgcgcccccccgtacctcggacgtcccccaacagagctgttattcggtggggtcattgtcactcttgtcatcgtctagcttgtgtttccctcatgagcccgggagctccatgaaggcagtgaccatgtctccctcttattccccaaatattgcctggcactgagtaagtgctccatccatacttgctgaatgaatgaatgaatgaatgaatgaattggccccatccttaccacttaaatctaatggtgagcagacttttttttttttttttgagacggagtctgactgtcgcccaggctggagtgcagtggcgcgatctcggctcactgcaagctccgcctcccgcgttcatgccattctcctgcctcagcctcccaagcagctgggactacaggtgcgcgccaccacgcccagataatttttgtatttttagtagggacaaggcttcagcatattggccaggctgatctcaaactcctgacctcaaatgatctgcccgcctcagcctcccaaagtgctgggattacaggcgtgagccaccgcgcctggcagtgaccagacttttgactgcaccgatgaaacca

SEQ ID NO: 8395 - DNA, 601 bp, Human
agtagacgctgatgaacacacctgcctcgatgcgcccccccgtacctcggacgtcccccaacagagctgttattcggtggggtcattgtcactcttgtcatcgtctagcttgtgtttccctcatgagcccgggagctccatgaaggcagtgaccatgtctccctcttattccccaaatattgcctggcactgagtaagtgctccatccatacttgctgaatgaatgaatgaatgaatgaatgaattggccccatccttaccacttaaatctaatggtgagcagacttttttttttttttttgagacggagtctcactgtcgcccaggctggagtgcagtggcgcgatctcggctcactgcaagctccgcctcccgcgttcatgccattctcctgcctcagcctcccaagcagctgggactacaggtgcgcgccaccacgcccagataatttttgtatttttagtagggacaaggcttcagcatattggccaggctgatctcaaactcctgacctcaaatgatctgcccgcctcagcctcccaaagtgctgggattacaggcgtgagccaccgcgcctggcagtgaccagacttttgactgc

SEQ ID NO: 8396 - DNA, 601 bp, Human
ctgccatccccttcccgttccttctcatgctaattcccagtcaccctgcaaatcctagtagacgctgatgaacacacctgcctcgatgcgcccccccgtacctcggacgtcccccaacagagctgttattcggtggggtcattgtcactcttgtcatcgtctagcttgtgtttccctcatgagcccgggagctccatgaaggcagtgaccatgtctccctcttattccccaaatattgcctggcactgagtaagtgctccatccatacttgctgaatgaatgaatgaatgaatgaatgaattggccccatccttaccacttaaatctaatggtgagcagacttttttttttttttttgagacggagtctcactgtcgcccaggctggagtgcagtggcgcgatctcggctcactgcaagctccgcctcccgcgttcatgccattctcctgcctcagcctcccaagcagctgggactacaggtgcgcgccaccacgcccagataatttttgtatttttagtagggacaaggcttcagcatattggccaggctgatctcaaactcctgacctcaaatgatctgcccgcctcagcctcccaaag

SEQ ID NO: 8397 - DNA, 601 bp, Human
tgtgcattcttctgtatggcacatgttgataaaattttacccaaaccaaacacaatcttgacctttaattcatcttcgtgcaacacaaaactccctgaaaacctcaccacccctcccggcttcagaccctctagttcctccaaaccctcagtgcctgggtgacgaggcaccaccacactctcccagcttacttttcatcactgtcagctttagccacacgtgattttctcagtttcctgaccttactcagccggcctccaggcttctgatcaagctgttctctgtgcctgccatccccttmccgttccttctcatgctaattcccagtcaccctgcaaatcctagtagacgctgatgaacacacctgcctcgatgcgcccccccgtacctcggacgtcccccaacagagctgttattcggtggggtcattgtcactcttgtcatcgtctagcttgtgtttccctcatgagcccgggagctccatgaaggcagtgaccatgtctccctcttattccccaaatattgcctggcactgagtaagtgctccatccatacttgctgaatgaatgaatgaatgaatgaatgaattggccccatcctt

SEQ ID NO: 8398 - DNA, 601 bp, Human
gggtgtgcattcttctgtatggcacatgttgataaaattttacccaaaccaaacacaatcttgacctttaattcatcttcgtgcaacacaaaactccctgaaaacctcaccacccctcccggcttcagaccctctagttcctccaaaccctcagtgcctgggtgacgaggcaccaccacactctcccagcttacttttcatcactgtcagctttagccacacgtgattttctcagtttcctgaccttactcagccggcctccaggcttctgatcaagctgttctctgtgcctgccatcccyttcccgttccttctcatgctaattcccagtcaccctgcaaatcctagtagacgctgatgaacacacctgcctcgatgcgcccccccgtacctcggacgtcccccaacagagctgttattcggtggggtcattgtcactcttgtcatcgtctagcttgtgtttccctcatgagcccgggagctccatgaaggcagtgaccatgtctccctcttattccccaaatattgcctggcactgagtaagtgctccatccatacttgctgaatgaatgaatgaatgaatgaatgaattggccccatc

SEQ ID NO: 8399 - DNA, 601 bp, Human
cttggcctcccaaagtgctgggatgacaggcgtgagcccccgcgcccagccgggtgtgcattcttctgtatggcacatgttgataaaattttacccaaaccaaacacaatcttgacctttaattcatcttcgtgcaacacaaaactccctgaaaacctcaccacccctcccggcttcagaccctctagttcctccaaaccctcagtgcctgggtgacgaggcaccaccacactctcccagcttacttttcatcactgtcagctttagccacacgtgattttctcagtttcctgaccttacwcagccggcctccaggcttctgatcaagctgttctctgtgcctgccatccccttcccgttccttctcatgctaattcccagtcaccctgcaaatcctagtagacgctgatgaacacacctgcctcgatgcgcccccccgtacctcggacgtcccccaacagagctgttattcggtggggtcattgtcactcttgtcatcgtctagcttgtgtttccctcatgagcccgggagctccatgaaggcagtgaccatgtctccctcttattccccaaatattgcctggcactgagtaagtgctcc

SEQ ID NO: 8400 - DNA, 601 bp, Human
ggccaggctggtctggaactcctgacctcaggtgacccgcccgccttggcctcccaaagtgctgggatgacaggcgtgagcccccgcgcccagccgggtgtgcattcttctgtatggcacatgttgataaaattttacccaaaccaaacacaatcttgacctttaattcatcttcgtgcaacacaaaactccctgaaaacctcaccacccctcccggcttcagaccctctagttcctccaaaccctcagtgcctgggtgacgaggcaccaccacactctcccagcttacttttcatcactstcagctttagccacacgtgattttctcagtttcctgaccttactcagccggcctccaggcttctgatcaagctgttctctgtgcctgccatccccttcccgttccttctcatgctaattcccagtcaccctgcaaatcctagtagacgctgatgaacacacctgcctcgatgcgcccccccgtacctcggacgtcccccaacagagctgttattcggtggggtcattgtcactcttgtcatcgtctagcttgtgtttccctcatgagcccgggagctccatgaaggcagtgaccatgtct

SEQ ID NO: 8401 - DNA, 601 bp, Human
ggctaatttttatatttttagtggagacggggtttcaccatgttggccaggctggtctggaactcctgacctcaggtgacccgcccgccttggcctcccaaagtgctgggatgacaggcgtgagcccccgcgcccagccgggtgtgcattcttctgtatggcacatgttgataaaattttacccaaaccaaacacaatcttgacctttaattcatcttcgtgcaacacaaaactccctgaaaacctcaccacccctcccggcttcagaccctctagttcctccaaaccctcagtgcctgggtgacgaggcaccaccacactctcccagcttacttttcatcactgtcagctttagccacacgtgattttctcagtttcctgaccttactcagccggcctccaggcttctgatcaagctgttctctgtgcctgccatccccttcccgttccttctcatgctaattcccagtcaccctgcaaatcctagtagacgctgatgaacacacctgcctcgatgcgcccccccgtacctcggacgtcccccaacagagctgttattcggtggggtcattgtcactcttgtcatcgtctagcttgtgtt

SEQ ID NO: 8402 - DNA, 601 bp, Human
ccggctaatttttatatttttagtggagacggggtttcaccatgttggccaggctggtctggaactcctgacctcaggtgacccgcccgccttggcctcccaaagtgctgggatgacaggcgtgagcccccgcgcccagccgggtgtgcattcttctgtatggcacatgttgataaaattttacccaaaccaaacacaatcttgacctttaattcatcttcgtgcaacacaaaactccctgaaaacctcaccacccctcccggcttcagaccctctagttcctccaaaccctcagtgccttggtgacgaggcaccaccacactctcccagcttacttttcatcactgtcagctttagccacacgtgattttctcagtttcctgaccttactcagccggcctccaggcttctgatcaagctgttctctgtgcctgccatccccttcccgttccttctcatgctaattcccagtcaccctgcaaatcctagtagacgctgatgaacacacctgcctcgatgcgcccccccgtacctcggacgtcccccaacagagctgttattcggtggggtcattgtcactcttgtcatcgtctagcttgtg

SEQ ID NO: 8403 - DNA, 601 bp, Human
acccggctaatttttatatttttagtggagacggggtttcaccatgttggccaggctggtctggaactcctgacctcaggtgacccgcccgccttggcctcccaaagtgctgggatgacaggcgtgagcccccgcgcccagccgggtgtgcattcttctgtatggcacatgttgataaaattttacccaaaccaaacacaatcttgacctttaattcatcttcgtgcaacacaaaactccctgaaaacctcaccacccctcccggcttcagaccctctagttcctccaaaccctcagtgcatgggtgacgaggcaccaccacactctcccagcttacttttcatcactgtcagctttagccacacgtgattttctcagtttcctgaccttactcagccggcctccaggcttctgatcaagctgttctctgtgcctgccatccccttcccgttccttctcatgctaattcccagtcaccctgcaaatcctagtagacgctgatgaacacacctgcctcgatgcgcccccccgtacctcggacgtcccccaacagagctgttattcggtggggtcattgtcactcttgtcatcgtctagcttg

SEQ ID NO: 8404 - DNA, 601 bp, Human
ggctaatccacggagatgaaagtcagctgggggttactcttggcagcagatgtgtctggaagggagtgcggggcttagagggggcctaggcgccgcagctcacgtgcccttgatctgcatgctgcttacacagtgcttcactctgcggatgttcactgcgctgcatgcttatgaggtgtgcatttttctctctctctttttttttttttttggagagacagagtttcattcttattgcccaggctggagtgcaatgctgcggtcttggctcactgtaacctccacctcccgggttcaagcrattctcctgcctctcctaagtagctgggattacaagcgcccaccaccacacccggctaatttttatatttttagtggagacggggtttcaccatgttggccaggctggtctggaactcctgacctcaggtgacccgcccgccttggcctcccaaagtgctgggatgacaggcgtgagcccccgcgcccagccgggtgtgcattcttctgtatggcacatgttgataaaattttacccaaaccaaacacaatcttgacctttaattcatcttcgtgcaacacaaaactccctgaaaacctc

SEQ ID NO: 8405 - DNA, 601 bp, Human
gagaggagcccgacgtagcggggcacacaccgtatgcctcgttgatactaaatgcaaaaccaggcgaggctaatccacggagatgaaagtcagctgggggttactcttggcagcagatgtgtctggaagggagtgcggggcttagagggggcctaggcgccgcagctcacgtgcccttgatctgcatgctgcttacacagtgcttcactctgcggatgttcactgcgctgcatgcttatgaggtgtgcatttttctctctctctttttttttttttttggagagacagagtttcattcttrttgcccaggctggagtgcaatgctgcggtcttggctcactgtaacctccacctcccgggttcaagcaattctcctgcctctcctaagtagctgggattacaagcgcccaccaccacacccggctaatttttatatttttagtggagacggggtttcaccatgttggccaggctggtctggaactcctgacctcaggtgacccgcccgccttggcctcccaaagtgctgggatgacaggcgtgagcccccgcgcccagccgggtgtgcattcttctgtatggcacatgttgataaaatttt

SEQ ID NO: 8406 - DNA, 601 bp, Human
acaggatggatgaaattcacaggccttatgtggagagagaggagcccgacgtagcggggcacacaccgtatgcctcgttgatactaaatgcaaaaccaggcgaggctaatccacggagatgaaagtcagctgggggttactcttggcagcagatgtgtctggaagggagtgcggggcttagagggggcctaggcgccgcagctcacgtgcccttgatctgcatgctgcttacacagtgcttcactctgcggatgttcactgcgctgcatgcttatgaggtgtgcatttttctctctctctytttttttttttttggagagacagagtttcattcttattgcccaggctggagtgcaatgctgcggtcttggctcactgtaacctccacctcccgggttcaagcaattctcctgcctctcctaagtagctgggattacaagcgcccaccaccacacccggctaatttttatatttttagtggagacggggtttcaccatgttggccaggctggtctggaactcctgacctcaggtgacccgcccgccttggcctcccaaagtgctgggatgacaggcgtgagcccccgcgcccagccgggtg

SEQ ID NO: 8407 - DNA, 601 bp, Human
caacaggatggatgaaattcacaggccttatgtggagagagaggagcccgacgtagcggggcacacaccgtatgcctcgttgatactaaatgcaaaaccaggcgaggctaatccacggagatgaaagtcagctgggggttactcttggcagcagatgtgtctggaagggagtgcggggcttagagggggcctaggcgccgcagctcacgtgcccttgatctgcatgctgcttacacagtgcttcactctgcggatgttcactgcgctgcatgcttatgaggtgtgcatttttctctctctytttttttttttttttggagagacagagtttcattcttattgcccaggctggagtgcaatgctgcggtcttggctcactgtaacctccacctcccgggttcaagcaattctcctgcctctcctaagtagctgggattacaagcgcccaccaccacacccggctaatttttatatttttagtggagacggggtttcaccatgttggccaggctggtctggaactcctgacctcaggtgacccgcccgccttggcctcccaaagtgctgggatgacaggcgtgagcccccgcgcccagccggg

SEQ ID NO: 8408 - DNA, 601 bp, Human
ggcaacaggatggatgaaattcacaggccttatgtggagagagaggagcccgacgtagcggggcacacaccgtatgcctcgttgatactaaatgcaaaaccaggcgaggctaatccacggagatgaaagtcagctgggggttactcttggcagcagatgtgtctggaagggagtgcggggcttagagggggcctaggcgccgcagctcacgtgcccttgatctgcatgctgcttacacagtgcttcactctgcggatgttcactgcgctgcatgcttatgaggtgtgcatttttctctctytctttttttttttttttggagagacagagtttcattcttattgcccaggctggagtgcaatgctgcggtcttggctcactgtaacctccacctcccgggttcaagcaattctcctgcctctcctaagtagctgggattacaagcgcccaccaccacacccggctaatttttatatttttagtggagacggggtttcaccatgttggccaggctggtctggaactcctgacctcaggtgacccgcccgccttggcctcccaaagtgctgggatgacaggcgtgagcccccgcgcccagccg

SEQ ID NO: 8409 - DNA, 601 bp, Human
aacgctgactgaaacctgctcacaccctacaaacagtatggaaaactgaatgcagaaccaattgcataacttctgacccagcaatcccactcctgagcacatatgccctccccaaaaatgagtacattctttgggatcaactctgagggattaaaaaaaaaaaagaacattcatccatcaaaaggaggtgcacatcagtgctattcatcacagcccaagaaaacagcccaaatgccaatcatcagtactgtcgacacaatgtaaccctggcaaccagaagaagtaccgcctggggcaacasgatggatgaaattcacaggccttatgtggagagagaggagcccgacgtagcggggcacacaccgtatgcctcgttgatactaaatgcaaaaccaggcgaggctaatccacggagatgaaagtcagctgggggttactcttggcagcagatgtgtctggaagggagtgcggggcttagagggggcctaggcgccgcagctcacgtgcccttgatctgcatgctgcttacacagtgcttcactctgcggatgttcactgcgctgcatgcttatgaggtgtgcatttttctctctctcttttt

SEQ ID NO: 8410 - DNA, 601 bp, Human
cgggctccaaactctctcctgcaccctggcctttaggcttctgagagagggactgtgaatgtcggtgggacctggagctgaggcgtggggtcgctgggtattggtgggagggaactaggcaggagacagttacagaaaacgctgactgaaacctgctcacaccctacaaacagtatggaaaactgaatgcagaaccaattgcataacttctgacccagcaatcccactcctgagcacatatgccctccccaaaaatgagtacattctttgggatcaactctgagggattaaaaaaaaaaaagaacattcatccatcaaaaggaggtgcacatcagtgctattcatcacagcccaagaaaacagcccaaatgccaatcatcagtactgtcgacacaatgtaaccctggcaaccagaagaagtaccgcctggggcaacaggatggatgaaattcacaggccttatgtggagagagaggagcccgacgtagcggggcacacaccgtatgcctcgttgatactaaatgcaaaaccaggcgaggctaatccacggagatgaaagtcagctgggggttactcttggcagcagatgtgtctggaaggg

SEQ ID NO: 8411 - DNA, 601 bp, Human
tctcaagcaggagcacagcccctgcctttttctaggcccgagttggccagccagcgcacttcctgccccatgcagcaggcccgtggtctcaggccccactctctgcagcaggaacccagaagtgcctcccaccacatcctcctccccagcgtgttcaagcctgggagcccctctctgcttcagcaggtgttcagggagccccgctgggccctcccccagcccctggtggactcagagccctctgcgacacgggctccaaactctctcctgcaccctggcctttaggcttctgagagagggrctgtgaatgtcggtgggacctggagctgaggcgtggggtcgctgggtattggtgggagggaactaggcaggagacagttacagaaaacgctgactgaaacctgctcacaccctacaaacagtatggaaaactgaatgcagaaccaattgcataacttctgacccagcaatcccactcctgagcacatatgccctccccaaaaatgagtacattctttgggatcaactctgagggattaaaaaaaaaaaagaacattcatccatcaaaaggaggtgcacatcagtgctattcatcacagcc

SEQ ID NO: 8412 - DNA, 601 bp, Human
gcctctgcctcctgagtagctgggattacaggcatgtgccaccaccacacccggttaatttttgtatttttattagagatggggtttcaccatgttggccaggctgctcttgaactcctgagctcaggtgatctgcctgccttggccttccaaagtgctgagactacaggcacgagccaccatgcctgaccttatttagtattttgtatttaaatgtttaacaatctttttaactggtcactgacttgaagctcacatcttgccttcacccagctctaacctgtcctgttctcagggtttmtttctttctttcttttttttttttttcttttttttgagatggagtctcactctgtcgcccaggctggagtgcaatggcatgatcttggctcactgcaacctctgcctcctgggttcaagtgattctcctgcctcagcctcctgagtagctggaattacaggcacctgccaccatgcccagctaaatttttttttttttggtatctttagtagagatgggttttcaccatgttggccaggctggtctcgaactcctgacctcaagtgatctgccggcctcagcctcccaaagtgctgggat

SEQ ID NO: 8413 - DNA, 601 bp, Human
ttcttcccacctggactgcgcgttcccaggaggccatcatgaacagctgtgcagggtgcgcactgcagatcccaagactgccattcatgccgccatcatgcaatgacatggcctggggccctctgagctgcctctgcttcccacaccttttatcccccactgccgggagtttgcaggtttgttgaccacgtggctgacaaaccattgacccaccagctctgacagaggactggccatcagctcgcagccacaggggccctgttacaccctgagctgggtacagcccagcaacccttgtccrtctcctgcctttatttattgctttagtatgtttttcgttgtttgtttgctttttgagatggagtctcactctgtctcccaggctggagtgcagtggcgtgatctcggctcactgcaacctccgcctccctggttcaagtgattctcctgccttagcctctgcctcctgagtagctgggattacaggcatgtgccaccaccacacccggttaatttttgtatttttattagagatggggtttcaccatgttggccaggctgctcttgaactcctgagctcaggtgatctgcctgccttggc

SEQ ID NO: 8414 - DNA, 601 bp, Human
tctccagatgctccttccatcatcgtccggccttgttgatggtaatagcctcctgttattttgtggggtttgtttgttttttaggtagtgtcttgctctgttgtccaggctggagtgcagtagtgtgatcacagctcactgcagccttgacctcccgggctcagcaatcctcctacctcagcctcacaagttgctgggcctacaggagcgagttaccttgcccagctaattttgttaatttgtctatagagatgaagtctcactgtgttgcccaagctgatcctgggctcaagcactcccrccttggtcttccaaagtgtcagagaaagatgcaaagcttactatgctgcaggcttgaggaggaggaggccgtgagccaaggaatgcaggcagcttctagaagccaaataaggcaagaaaacagattctcccccagagcttctagaagggacccagccctgctgacaccttttcagacttctggcctccaaaactacaagaaaacttctatattaatagaagtgagccactgtgcctggcccacttatttggtttttaatttactcatgtaattttttttttaagacagagtctccttctg

SEQ ID NO: 8415 - DNA, 601 bp, Human
gagacagggtttcaccatgttggccaggctggtcttgatatcctgacctcaggtgatccacccacctcagcctcccaaagtgctggaattacaagcatgagccaccgtgcctgactctccaaattatttctagaaagcaactcttctccagatgctccttccatcatcgtccggccttgttgatggtaatagcctcctgttattttgtggggtttgtttgttttttaggtagtgtcttgctctgttgtccaggctggagtgcagtagtgtgatcacagctcactgcagccttgacctcccsggctcagcaatcctcctacctcagcctcacaagttgctgggcctacaggagcgagttaccttgcccagctaattttgttaatttgtctatagagatgaagtctcactgtgttgcccaagctgatcctgggctcaagcactcccaccttggtcttccaaagtgtcagagaaagatgcaaagcttactatgctgcaggcttgaggaggaggaggccgtgagccaaggaatgcaggcagcttctagaagccaaataaggcaagaaaacagattctcccccagagcttctagaagggacccagc

SEQ ID NO: 8416 - DNA, 601 bp, Human
gttttcaccatgttggccaggctggtcttgaactcctgacctcaggtgatccactcacttcggcctcccaaattgctgggattacaggtgtgagccaccacacccggccaatttttgtatttttagtagagacagggtttcaccatgttggccaggctggtcttgatatcctgacctcaggtgatccacccacctcagcctcccaaagtgctggaattacaagcatgagccaccgtgcctgactctccaaattatttctagaaagcaactcttctccagatgctccttccatcatcgtcckgccttgttgatggtaatagcctcctgttattttgtggggtttgtttgttttttaggtagtgtcttgctctgttgtccaggctggagtgcagtagtgtgatcacagctcactgcagccttgacctcccgggctcagcaatcctcctacctcagcctcacaagttgctgggcctacaggagcgagttaccttgcccagctaattttgttaatttgtctatagagatgaagtctcactgtgttgcccaagctgatcctgggctcaagcactcccaccttggtcttccaaagtgtcagagaaag

SEQ ID NO: 8417 - DNA, 601 bp, Human
ctgcgattacaggcgcccgccaccatgaccagctaattttcgtatttttagtacagatggggttttcaccatgttggccaggctggtcttgaactcctgacctcaggtgatccactcacttcggcctcccaaattgctgggattacaggtgtgagccaccacacccggccaatttttgtatttttagtagagacagggtttcaccatgttggccaggctggtcttgatatcctgacctcaggtgatccacccacctcagcctcccaaagtgctggaattacaagcatgagccaccgtgccygactctccaaattatttctagaaagcaactcttctccagatgctccttccatcatcgtccggccttgttgatggtaatagcctcctgttattttgtggggtttgtttgttttttaggtagtgtcttgctctgttgtccaggctggagtgcagtagtgtgatcacagctcactgcagccttgacctcccgggctcagcaatcctcctacctcagcctcacaagttgctgggcctacaggagcgagttaccttgcccagctaattttgttaatttgtctatagagatgaagtctcactgtgt

SEQ ID NO: 8418 - DNA, 601 bp, Human
taaggatcatgagatgggggggttatcctggattatctaggtgggctcagtgaaatcacaagggtccttctatgagggaggccccgaaaacggtggcatgggcgagccgcagggactcagggggacgttgaggcaggcagaggggagaagtggcgagactgcagggaatgctgggagcctcccaaggaggcctctcccatcccagaagcccccagggctgtcctggctgggctgtaaagccccagtgtaatcacaaaagtccttctaggagggaggcaggagaatcagagtcggagaaagwtgtgaagcttgctatgctgcaggcctaaggaggaggaggagcccgtcagccaaggaatgcaagcagcttctagaagcctaaaaaggcaagaaaacagattctcccccagagcttctagaagggacccagccctgctgatagcttttcagacttctgacctccaaaactacaagataataaacttgcagctgggctcagtgtctcacacctgtcatcccagcactttgggaggccgaggcaggcggatcacctgaggtcaggagttcaagaccagcctggccaacagggtgaaaccccgtc

SEQ ID NO: 8419 - DNA, 601 bp, Human
ttcctgtgaaggtcaccaggggcccccacaatgccacatccaacggaccgctctctgtcctcatcttcctcaacctctcagaagccccaaacatgagtaaccatctccttcgaacacttttttctagatttctgcctactctctcctcattcctcaaggcttcgctggtgccttcgcggtctgacctctatctgccaccaggatctgggggctgggtcactgtcttccttgccggcacactctccctagtgatcccttccaagcccatggcttcaatacacctataacggctgaaattccyacctctccatctgctatcgtaggcagaataatggccccccaaagaaggccacgtcctaatccccagaacctgtgaatatgttgccttttatggcaaaagggacttcgtagatgtgagttaataaattaaggatcatgagatgggggggttatcctggattatctaggtgggctcagtgaaatcacaagggtccttctatgagggaggccccgaaaacggtggcatgggcgagccgcagggactcagggggacgttgaggcaggcagaggggagaagtggcgagactgcagggaatgctgg

SEQ ID NO: 8420 - DNA, 601 bp, Human
tgtcataggggatggtggggaggggacgaggggcttggtggttaacagtgaaccaagtccaaggtctttctgcagagggcagtagaagtcatggaggactttataaaggggaagcacatgattagctgtgctttcaaaagctcatgatgaggccgggcgcggtggctcacgcctgtaatcccagcactttgggaggccgaggcaggcagatcacgaggtcaggagatcgagaccatcctggctaacatggtgaaaccccgtctctactaaaaatacaaaaaattagccgggcgtggtggcrggtgcctgtagtcccagctactcgggagcctgaggcaggagaatggtgtgaacccaggaggcagaggttgcagtgagccgagatcacgccactgaactccagcctgggtgacagagcgagactctgtctcaaaaaaaaaaaaaaaaaaaaaaaggtcatgatgtggctacagtgggttgggacagactaaagagcacaggaaggtggggcagaaatgagataccgtctccacttcctcaactcctatcactctacattttaatacattatgaaatatattcacgtatcggcatggcttac

SEQ ID NO: 8421 - DNA, 601 bp, Human
caggagaactgggctgtcctgagacagacagtgagctccgggggttgtcataggggatggtggggaggggacgaggggcttggtggttaacagtgaaccaagtccaaggtctttctgcagagggcagtagaagtcatggaggactttataaaggggaagcacatgattagctgtgctttcaaaagctcatgatgaggccgggcgcggtggctcacgcctgtaatcccagcactttgggaggccgaggcaggcagatcacgaggtcaggagatcgagaccatcctggctaacatggtgaaascccgtctctactaaaaatacaaaaaattagccgggcgtggtggcgggtgcctgtagtcccagctactcgggagcctgaggcaggagaatggtgtgaacccaggaggcagaggttgcagtgagccgagatcacgccactgaactccagcctgggtgacagagcgagactctgtctcaaaaaaaaaaaaaaaaaaaaaaaggtcatgatgtggctacagtgggttgggacagactaaagagcacaggaaggtggggcagaaatgagataccgtctccacttcctcaactcctatcactctac

SEQ ID NO: 8422 - DNA, 601 bp, Human; identical to SEQ ID NO: 2059

SEQ ID NO: 8423 - DNA, 601 bp, Human; identical to SEQ ID NO: 2060

SEQ ID NO: 8424 - DNA, 601 bp, Human; identical to SEQ ID NO: 2061

SEQ ID NO: 8425 - DNA, 601 bp, Human; identical to SEQ ID NO: 2062

SEQ ID NO: 8426 - DNA, 601 bp, Human; identical to SEQ ID NO: 2063

SEQ ID NO: 8427 - DNA, 601 bp, Human; identical to SEQ ID NO: 2064

SEQ ID NO: 8428 - DNA, 601 bp, Human; identical to SEQ ID NO: 2065

SEQ ID NO: 8429 - DNA, 601 bp, Human; identical to SEQ ID NO: 2066

SEQ ID NO: 8430 - DNA, 601 bp, Human; identical to SEQ ID NO: 2067

SEQ ID NO: 8431 - DNA, 601 bp, Human; identical to SEQ ID NO: 2068

SEQ ID NO: 8432 - DNA, 601 bp, Human; identical to SEQ ID NO: 2069

SEQ ID NO: 8433 - DNA, 601 bp, Human; identical to SEQ ID NO: 2070

SEQ ID NO: 8434 - DNA, 601 bp, Human; identical to SEQ ID NO: 2071

SEQ ID NO: 8435 - DNA, 601 bp, Human; identical to SEQ ID NO: 2072

SEQ ID NO: 8436 - DNA, 601 bp, Human; identical to SEQ ID NO: 2073

SEQ ID NO: 8437 - DNA, 601 bp, Human; identical to SEQ ID NO: 2074

SEQ ID NO: 8438 - DNA, 601 bp, Human; identical to SEQ ID NO: 2075

SEQ ID NO: 8439 - DNA, 601 bp, Human; identical to SEQ ID NO: 2076

SEQ ID NO: 8440 - DNA, 601 bp, Human; identical to SEQ ID NO: 2077

SEQ ID NO: 8441 - DNA, 601 bp, Human; identical to SEQ ID NO: 2078

SEQ ID NO: 8442 - DNA, 601 bp, Human; identical to SEQ ID NO: 2079

SEQ ID NO: 8443 - DNA, 601 bp, Human; identical to SEQ ID NO: 2080

SEQ ID NO: 8444 - DNA, 601 bp, Human; identical to SEQ ID NO: 2081

SEQ ID NO: 8445 - DNA, 601 bp, Human; identical to SEQ ID NO: 2082

SEQ ID NO: 8446 - DNA, 601 bp, Human; identical to SEQ ID NO: 2083

SEQ ID NO: 8447 - DNA, 601 bp, Human; identical to SEQ ID NO: 2084

SEQ ID NO: 8448 - DNA, 601 bp, Human; identical to SEQ ID NO: 2085

SEQ ID NO: 8449 - DNA, 601 bp, Human; identical to SEQ ID NO: 2086

SEQ ID NO: 8450 - DNA, 601 bp, Human; identical to SEQ ID NO: 2087

SEQ ID NO: 8451 - DNA, 601 bp, Human; identical to SEQ ID NO: 2088

SEQ ID NO: 8452 - DNA, 601 bp, Human; identical to SEQ ID NO: 2089

SEQ ID NO: 8453 - DNA, 601 bp, Human; identical to SEQ ID NO: 2090

SEQ ID NO: 8454 - DNA, 601 bp, Human; identical to SEQ ID NO: 2091

SEQ ID NO: 8455 - DNA, 601 bp, Human; identical to SEQ ID NO: 2092

SEQ ID NO: 8456 - DNA, 601 bp, Human; identical to SEQ ID NO: 2093

SEQ ID NO: 8457 - DNA, 601 bp, Human; identical to SEQ ID NO: 2094

SEQ ID NO: 8458 - DNA, 601 bp, Human; identical to SEQ ID NO: 2095

SEQ ID NO: 8459 - DNA, 601 bp, Human; identical to SEQ ID NO: 2096

SEQ ID NO: 8460 - DNA, 601 bp, Human; identical to SEQ ID NO: 2097

SEQ ID NO: 8461 - DNA, 601 bp, Human; identical to SEQ ID NO: 2098

SEQ ID NO: 8462 - DNA, 601 bp, Human; identical to SEQ ID NO: 2099

SEQ ID NO: 8463 - DNA, 601 bp, Human; identical to SEQ ID NO: 2100

SEQ ID NO: 8464 - DNA, 601 bp, Human; identical to SEQ ID NO: 2101

SEQ ID NO: 8465 - DNA, 601 bp, Human; identical to SEQ ID NO: 2102

SEQ ID NO: 8466 - DNA, 601 bp, Human; identical to SEQ ID NO: 2103

SEQ ID NO: 8467 - DNA, 601 bp, Human; identical to SEQ ID NO: 2104

SEQ ID NO: 8468 - DNA, 601 bp, Human; identical to SEQ ID NO: 2105

SEQ ID NO: 8469 - DNA, 601 bp, Human; identical to SEQ ID NO: 2106

SEQ ID NO: 8470 - DNA, 601 bp, Human; identical to SEQ ID NO: 2107

SEQ ID NO: 8471 - DNA, 601 bp, Human; identical to SEQ ID NO: 2108

SEQ ID NO: 8472 - DNA, 601 bp, Human; identical to SEQ ID NO: 2109

SEQ ID NO: 8473 - DNA, 601 bp, Human; identical to SEQ ID NO: 2110

SEQ ID NO: 8474 - DNA, 601 bp, Human; identical to SEQ ID NO: 2111

SEQ ID NO: 8475 - DNA, 601 bp, Human; identical to SEQ ID NO: 2112

SEQ ID NO: 8476 - DNA, 601 bp, Human; identical to SEQ ID NO: 2113

SEQ ID NO: 8477 - DNA, 601 bp, Human; identical to SEQ ID NO: 2114

SEQ ID NO: 8478 - DNA, 601 bp, Human; identical to SEQ ID NO: 2115

SEQ ID NO: 8479 - DNA, 601 bp, Human; identical to SEQ ID NO: 2116

SEQ ID NO: 8480 - DNA, 601 bp, Human; identical to SEQ ID NO: 2117

SEQ ID NO: 8481 - DNA, 601 bp, Human; identical to SEQ ID NO: 2118

SEQ ID NO: 8482 - DNA, 601 bp, Human; identical to SEQ ID NO: 2119

SEQ ID NO: 8483 - DNA, 601 bp, Human; identical to SEQ ID NO: 2120

SEQ ID NO: 8484 - DNA, 601 bp, Human; identical to SEQ ID NO: 2121

SEQ ID NO: 8485 - DNA, 601 bp, Human; identical to SEQ ID NO: 2122

SEQ ID NO: 8486 - DNA, 601 bp, Human; identical to SEQ ID NO: 2123

SEQ ID NO: 8487 - DNA, 601 bp, Human; identical to SEQ ID NO: 2124

SEQ ID NO: 8488 - DNA, 601 bp, Human; identical to SEQ ID NO: 2125

SEQ ID NO: 8489 - DNA, 601 bp, Human; identical to SEQ ID NO: 2126

SEQ ID NO: 8490 - DNA, 601 bp, Human; identical to SEQ ID NO: 2127

SEQ ID NO: 8491 - DNA, 601 bp, Human; identical to SEQ ID NO: 2128

SEQ ID NO: 8492 - DNA, 601 bp, Human; identical to SEQ ID NO: 2129

SEQ ID NO: 8493 - DNA, 601 bp, Human; identical to SEQ ID NO: 2130

SEQ ID NO: 8494 - DNA, 601 bp, Human; identical to SEQ ID NO: 2131

SEQ ID NO: 8495 - DNA, 601 bp, Human; identical to SEQ ID NO: 2132

SEQ ID NO: 8496 - DNA, 601 bp, Human; identical to SEQ ID NO: 2133

SEQ ID NO: 8497 - DNA, 601 bp, Human; identical to SEQ ID NO: 2134

SEQ ID NO: 8498 - DNA, 601 bp, Human; identical to SEQ ID NO: 2135

SEQ ID NO: 8499 - DNA, 601 bp, Human; identical to SEQ ID NO: 2136

SEQ ID NO: 8500 - DNA, 601 bp, Human; identical to SEQ ID NO: 2137

SEQ ID NO: 8501 - DNA, 601 bp, Human; identical to SEQ ID NO: 2138

SEQ ID NO: 8502 - DNA, 601 bp, Human; identical to SEQ ID NO: 2139

SEQ ID NO: 8503 - DNA, 601 bp, Human; identical to SEQ ID NO: 2140

SEQ ID NO: 8504 - DNA, 601 bp, Human; identical to SEQ ID NO: 2141

SEQ ID NO: 8505 - DNA, 601 bp, Human; identical to SEQ ID NO: 2142

SEQ ID NO: 8506 - DNA, 601 bp, Human; identical to SEQ ID NO: 2143

SEQ ID NO: 8507 - DNA, 601 bp, Human; identical to SEQ ID NO: 2144

SEQ ID NO: 8508 - DNA, 601 bp, Human; identical to SEQ ID NO: 2145

SEQ ID NO: 8509 - DNA, 601 bp, Human; identical to SEQ ID NO: 2146

SEQ ID NO: 8510 - DNA, 601 bp, Human; identical to SEQ ID NO: 2147

SEQ ID NO: 8511 - DNA, 601 bp, Human; identical to SEQ ID NO: 2148

SEQ ID NO: 8512 - DNA, 601 bp, Human; identical to SEQ ID NO: 2149

SEQ ID NO: 8513 - DNA, 601 bp, Human; identical to SEQ ID NO: 2150

SEQ ID NO: 8514 - DNA, 601 bp, Human; identical to SEQ ID NO: 2151

SEQ ID NO: 8515 - DNA, 601 bp, Human; identical to SEQ ID NO: 2152

SEQ ID NO: 8516 - DNA, 601 bp, Human; identical to SEQ ID NO: 2153

SEQ ID NO: 8517 - DNA, 601 bp, Human; identical to SEQ ID NO: 2154

SEQ ID NO: 8518 - DNA, 601 bp, Human; identical to SEQ ID NO: 2155

SEQ ID NO: 8519 - DNA, 601 bp, Human; identical to SEQ ID NO: 2156

SEQ ID NO: 8520 - DNA, 601 bp, Human; identical to SEQ ID NO: 2157

SEQ ID NO: 8521 - DNA, 601 bp, Human; identical to SEQ ID NO: 3545

SEQ ID NO: 8522 - DNA, 601 bp, Human; identical to SEQ ID NO: 3546

SEQ ID NO: 8523 - DNA, 601 bp, Human; identical to SEQ ID NO: 3547

SEQ ID NO: 8524 - DNA, 601 bp, Human; identical to SEQ ID NO: 3548

SEQ ID NO: 8525 - DNA, 601 bp, Human; identical to SEQ ID NO: 3549

SEQ ID NO: 8526 - DNA, 601 bp, Human; identical to SEQ ID NO: 3550

SEQ ID NO: 8527 - DNA, 601 bp, Human; identical to SEQ ID NO: 3551

SEQ ID NO: 8528 - DNA, 601 bp, Human; identical to SEQ ID NO: 3552

SEQ ID NO: 8529 - DNA, 601 bp, Human
cggaggtgaaggtggcttgctccgaagatgtggacttgccctgcaccgccccctgggatccgcaggttccctacacggtctcctgggtcaaggtaggtgctgcgatacccacgggctggggtttggtgggctcatttgaagacagcaggaaccatctcccctaggctggcgaccctctgtggctgccaggtgggggcgaggggcgtctcccgcagctgaacttggagtacccagcctcccgtcgcgcctcccccaccccatccgcatccaggtacagggccgaattaggttttgctctccrcagacctcaatccccttcctgtcactgaaggtggcctgagatgaatgatccacttaagatgttttggaagggcagagactctctcatttggattaattctggaggccacctgtggttgtgggccagcaggtcaggaagaaagcaacagggacctagatttgggcattggacagggggaatgtctccagacttctgatttcttgtgttttgtgactgtgatgcccatgatacatgggagggggagggggcaatttgaaaggaaaggctaagacacagaagtgacttaggccatttcatcca

SEQ ID NO: 8530 - DNA, 601 bp, Human
cttcctgtcactgaaggtggcctgagatgaatgatccacttaagatgttttggaagggcagagactctctcatttggattaattctggaggccacctgtggttgtgggccagcaggtcaggaagaaagcaacagggacctagatttgggcattggacagggggaatgtctccagacttctgatttcttgtgttttgtgactgtgatgcccatgatacatgggagggggagggggcaatttgaaaggaaaggctaagacacagaagtgacttaggccatttcatccatggtagttatcagtrgtcatctcctttgtgggatacccttggcttcctcccctagccctcctcctccttcctctggcagccttgagagcatcaggtggatgcatgagccggagcccgcatgtgtaagaacaggccttgctgctcctactgtaagtggactgagtgacaaggaggctttttcaaggtttcctcttgactgaaacattctcagattctaagatggcaatgatggtgtcattccaaagccaagcagctactgtttgatatcactggtccttctttaagtcaggccactgctaccacagcacctccatt

SEQ ID NO: 8531 - DNA, 601 bp, Human
gatttcttgtgttttgtgactgtgatgcccatgatacatgggagggggagggggcaatttgaaaggaaaggctaagacacagaagtgacttaggccatttcatccatggtagttatcagtggtcatctcctttgtgggatacccttggcttcctcccctagccctcctcctccttcctctggcagccttgagagcatcaggtggatgcatgagccggagcccgcatgtgtaagaacaggccttgctgctcctactgtaagtggactgagtgacaaggaggctttttcaaggtttcctcttractgaaacattctcagattctaagatggcaatgatggtgtcattccaaagccaagcagctactgtttgatatcactggtccttctttaagtcaggccactgctaccacagcacctccattttaacccaaatgaatatgatattacaaccttactctgtagctctcactgatttgctgtcttaccacgggggcaaatctctgcacttgtagctttccccaaaatgcagggcgttcttctgcccaccataaaagatactataagaaactgtacgtctttggccacttaacagtacaaggcat

SEQ ID NO: 8532 - DNA, 601 bp, Human
agttgggatttgaacgaagcagtctgattccaaatcctgagttgttagaggtctatcttgatctctgttttctcccttaataacttaagataaagaaaatcaaagtgcccctgggctaaccaggcagggacttagttatctcaaagaacggggaaaaacatgaaaccactatcccttccagagagtaactatttaataaagaaaacattattaatacccccaggggagtaattaaaaagtactcatgaaacaagtagatgaaatttcaggctgtgaagttcaaacagttctggagtgaaakcttcttgcacagggtcatttggaatggtccactaaaccatagcaattaaccttggacttctccttggatgtcagctggtgacgtaactcggtaacgcatgagcttgtttattggacagaattcttgcgagatttacccccaaggtctttgaaagctctgtcaagaaaaaaagggacagcagtctctaggcgttctttttttcctgttgatccatggaatagtgccaatgaaaagtcataccgtagttattttttgagaagtaaatggtgattgagattcgtgggtaggagagttatgcta

SEQ ID NO: 8533 - DNA, 601 bp, Human
gaaagctctgtcaagaaaaaaagggacagcagtctctaggcgttctttttttcctgttgatccatggaatagtgccaatgaaaagtcataccgtagttattttttgagaagtaaatggtgattgagattcgtgggtaggagagttatgctataccaataaacgaatcaggtgcctcgaaagtgacatatattgttcctttaagcattttttttaaaacagctctcagcatgttctgtagatacttattattttccagcccaataattatactttttcattgattatgcttatacaacaaamatggatagagtgttctggagacaaggccagtggtgaaatgccaaaatacttcattttacagaatgttaagcatctggtcatttttctataagtttcttgtaaaatgtttcatcaaagtggaggggtagccacaaagggaggaatttcattttggtaaccagaaccagcttatcccatcctactcacttcatcatcactaccctggctttgtaaaacctgttttgccagcttaggagggggcttcatactgggcaaggaaagcagagtcccttgcagtgggttttcaccatccaccagatt

SEQ ID NO: 8534 - DNA, 601 bp, Human
cagagtgtcaccctgtttcccaagctggagtacagtggcatgaagatggctcactgcagcctcgacttcctgggctcgagtaatcctcccacctcagcctcccaagtagctgagactacaagggcgtaccaccacacctggctaatttttatgtttttaattttttgtagggacaagatttcaatacattgcccaggctggtctccaactcctgagctcaagccatcctcccacttcagcctcccaaagtgctaggattacaggcatgagccaatcgatttatcttttaaagttgtaatasactgggtgtggtggctgaggcttatgcctgtaatcccagcattttgggaggcgaagatgggaggatcacttgagcccaggagtttgaggccagcctgggcaatgcagtgagacctgtctctaccaaaaaaaaaaaaaaaaaaaaaaaagttgtaatagatgtggttctttgaggaggtattttgagaaaatatgcaaatagactttgatccatgacttttcttccactggccatgacctgtgattaaattccagcataaaagggcatagcacaatatcatgtctgtgaggagtaaagcca

SEQ ID NO: 8535 - DNA, 601 bp, Human
gtagctgagactacaagggcgtaccaccacacctggctaatttttatgtttttaattttttgtagggacaagatttcaatacattgcccaggctggtctccaactcctgagctcaagccatcctcccacttcagcctcccaaagtgctaggattacaggcatgagccaatcgatttatcttttaaagttgtaatagactgggtgtggtggctgaggcttatgcctgtaatcccagcattttgggaggcgaagatgggaggatcacttgagcccaggagtttgaggccagcctgggcaatgyagtgagacctgtctctaccaaaaaaaaaaaaaaaaaaaaaaaagttgtaatagatgtggttctttgaggaggtattttgagaaaatatgcaaatagactttgatccatgacttttcttccactggccatgacctgtgattaaattccagcataaaagggcatagcacaatatcatgtctgtgaggagtaaagccatgcattaaagggctgcatgtggacttcatgaaaagcgtcgctgtgtctacactctctttaatgtaggtttggagagagaggatgactttggttggagtactttgg

SEQ ID NO: 8536 - DNA, 601 bp, Human
aaaaaaaaaaaaaaaaaaaaagttgtaatagatgtggttctttgaggaggtattttgagaaaatatgcaaatagactttgatccatgacttttcttccactggccatgacctgtgattaaattccagcataaaagggcatagcacaatatcatgtctgtgaggagtaaagccatgcattaaagggctgcatgtggacttcatgaaaagcgtcgctgtgtctacactctctttaatgtaggtttggagagagaggatgactttggttggagtactttgggcctggttgataatcactaaagrtagtaatgagtgatcatttatcccagagttgcaatgccttcttgtatcatgctaggagccctgacagcctatgggtgatgcaaaacgaaagaggatatatggtgtcatctctgggtgatgctgcgggggtgaggagagtgaagcatcacaagacaagtgcccttttcagatgatttccaaaggaagggagaaaagggaagtaagagtgtgacttcatataaaagtctactataaatagactttataatattgagaagagccccagctggggcagatcatgggccatccatggagtgttct

SEQ ID NO: 8537 - DNA, 601 bp, Human
caaatagactttgatccatgacttttcttccactggccatgacctgtgattaaattccagcataaaagggcatagcacaatatcatgtctgtgaggagtaaagccatgcattaaagggctgcatgtggacttcatgaaaagcgtcgctgtgtctacactctctttaatgtaggtttggagagagaggatgactttggttggagtactttgggcctggttgataatcactaaagatagtaatgagtgatcatttatcccagagttgcaatgccttcttgtatcatgctaggagccctgacakcctatgggtgatgcaaaacgaaagaggatatatggtgtcatctctgggtgatgctgcgggggtgaggagagtgaagcatcacaagacaagtgcccttttcagatgatttccaaaggaagggagaaaagggaagtaagagtgtgacttcatataaaagtctactataaatagactttataatattgagaagagccccagctggggcagatcatgggccatccatggagtgttctgcttctgacattaacactaaggaaactgttggagagcaggttaatggcttgcgtgaggccacttcaa

SEQ ID NO: 8538 - DNA, 601 bp, Human
gccatgacctgtgattaaattccagcataaaagggcatagcacaatatcatgtctgtgaggagtaaagccatgcattaaagggctgcatgtggacttcatgaaaagcgtcgctgtgtctacactctctttaatgtaggtttggagagagaggatgactttggttggagtactttgggcctggttgataatcactaaagatagtaatgagtgatcatttatcccagagttgcaatgccttcttgtatcatgctaggagccctgacagcctatgggtgatgcaaaacgaaagaggatatatgrtgtcatctctgggtgatgctgcgggggtgaggagagtgaagcatcacaagacaagtgcccttttcagatgatttccaaaggaagggagaaaagggaagtaagagtgtgacttcatataaaagtctactataaatagactttataatattgagaagagccccagctggggcagatcatgggccatccatggagtgttctgcttctgacattaacactaaggaaactgttggagagcaggttaatggcttgcgtgaggccacttcaaaagttcaaggctgtcttccgtgtatgttgctaaac

SEQ ID NO: 8539 - DNA, 601 bp, Human
gcatagcacaatatcatgtctgtgaggagtaaagccatgcattaaagggctgcatgtggacttcatgaaaagcgtcgctgtgtctacactctctttaatgtaggtttggagagagaggatgactttggttggagtactttgggcctggttgataatcactaaagatagtaatgagtgatcatttatcccagagttgcaatgccttcttgtatcatgctaggagccctgacagcctatgggtgatgcaaaacgaaagaggatatatggtgtcatctctgggtgatgctgcgggggtgaggasagtgaagcatcacaagacaagtgcccttttcagatgatttccaaaggaagggagaaaagggaagtaagagtgtgacttcatataaaagtctactataaatagactttataatattgagaagagccccagctggggcagatcatgggccatccatggagtgttctgcttctgacattaacactaaggaaactgttggagagcaggttaatggcttgcgtgaggccacttcaaaagttcaaggctgtcttccgtgtatgttgctaaacttctttttggtggagttatgttttctgtctctac

SEQ ID NO: 8540 - DNA, 601 bp, Human
gtgttggatagaatatgattcatcttagaagatgagtctcagagggagacttcattcttttccttcttttcctcttggtcaccagtcctgtccatgtagttctgcggaggagtgggcaaggaagaatgaggccgcctctgagtggctatagaagaagtctcatctagatgagaatggtggatcactgagatttttggacaatagtggaacagagcacaagttgccaaaatcttttagcttgataatggggagggaggaagaaagcagctgagagttaaattgaaaaaaaaaaaaaaaaaaagctaaacaaaaaaaccaacttgttttccattaataaaagggggaacctgagtcacatgaggactggattgtcttagctacgtacttggcaatgtcactacacaaagaagaggaagtttggagaaggtctcagtgacataagggaaagttttatgtagggcaagactaaaagcagattgattacctaaaaaaagtttcctccctctaaagatgtttccgtaatcccttcctggctactcctggaataaccctaaattttgtatcaacaatcattagctcaaaatagagctgggcagaaaat

SEQ ID NO: 8541 - DNA, 601 bp, Human
tcccagaggagacgggaagtgtcagtggtaaggaaatgacagagtgggtggatggtgtggaaagctatcacagacaagaataatttctattaccagcattaccaattatacagcacttttcttgttttctcacttgattttataataaccccatgagcaagtaagggagctccagatcacgaaatggggctcagaggtgaagtgacatatggaagatgacccagctaacacatggagaaactgggattgacttcagacctttgattccaaagctagtgctcttgtaactttctcactcttyctaaaattcacgcattcattcagtaaatactttttcaatacgtcttatattcagggaactatttagtatgcagaatgaaaccttggttataaaaaaaaggagagagagagagtagtaacatcttcagggctttctgtgtgatcgatatgatgcttagggtctgtatacatcatcataagtatcttcacgccagctcagtgagatgtgatcacccccagattccagtggagctatccaagcctgagagtggttcagtcagttggccaagagcagaggtagccgtgggagggctggggtttg

SEQ ID NO: 8542 - DNA, 601 bp, Human
tacctattgcacattccccccacccctgcttttatttttttatttttttttaagacggagtcatgctctgtcacccaggctggagcgcaatggcacaatcttggctcactgcaaccttcgcctcctgggttcaagcgattctcctgcctcagcctcccaagtagctggaattacagatgtccactaccacgcccagctaatattttgtatttgtggtggagatgtggtttcaccatgttggcaaggctggtcttgaactcctgacctcatgtgatccacctgcctcagcctcccaaagtgytgggattacaggcatgagccaccgtgcctggccctgcattcttaacaaatctgctatatgataaatttagatttcaattttgtgatcaaaactctttttttgctataaaatgaaactattgccctcttagcttcaaatatggtaatgtaggaggttggcatatatttggataaaattatgtaaacttaaaaaaaaacactttccacaataggatgttttaatattggttcagtttcagccataattaatgatttattttatgtcttttgttttagttcaaattagttcatcattaaaaaa

SEQ ID NO: 8543 - DNA, 601 bp, Human
gctggatgggagaggagcttcccaggagaaaaccatgggtgaataatctcaaaacggttgttgcagctacactcgcatttggaggttaatttagaaaaagaaaagcaagattggacatcggaatggggactgcagggactgggccgagctaattatttcaaactggcctttcaggccatcctagacacagattggccctggatgggcctcggtctctggtctcttgaaagcccttgcctggtaggaagaagccgctctgccaggcagcggaagggagaggcaagcagtgtgagcccatgaygaggcttcagtttatggtttacttaggcttgaaaagggaaaaatggtgctaaattagatgtgttctggaatcagatggacactgttagtttcctctaaatttccttggccccacctcctttttgtgctttatttttgcacacctatgggccccagtcttttagcttcctcccatagattcttgattatttaggaaggaatctttccacacaaaaaggaccatcaagaaatgggatttatgtccgcagactcggcctgagaagagccgttcatctcagctcagggctgggagggagctgag

SEQ ID NO: 8544 - DNA, 601 bp, Human
tttgtgctttatttttgcacacctatgggccccagtcttttagcttcctcccatagattcttgattatttaggaaggaatctttccacacaaaaaggaccatcaagaaatgggatttatgtccgcagactcggcctgagaagagccgttcatctcagctcagggctgggagggagctgagcaggttttcttgcaggagcgatcaatctgccaccagatgtctctgtagcccactctacaggaatgctcacaaacaccagggctggagcctgagctttccggtgaccttgtggtatatgctstgaattaataaatgaagcagaaatgactgtgtgtgtgtgtgtgtgtgtgtgtgtgtgtatacgagtgcacacgtgcccatgtgtatgtattttctttcctgagttgcttctcagagtattcccctaactccttggttatctctttccctacactgagttccttcctaaaagtcagagaagagttgtagggtgctcccagaacgggagattcatcattgataggtgcaagcaaagacagtggcagtgggccctgataatctctgtctccttccctaaggtggctcttgggtgcagttatca

SEQ ID NO: 8545 - DNA, 601 bp, Human
gtggtatatgctctgaattaataaatgaagcagaaatgactgtgtgtgtgtgtgtgtgtgtgtgtgtgtgtatacgagtgcacacgtgcccatgtgtatgtattttctttcctgagttgcttctcagagtattcccctaactccttggttatctctttccctacactgagttccttcctaaaagtcagagaagagttgtagggtgctcccagaacgggagattcatcattgataggtgcaagcaaagacagtggcagtgggccctgataatctctgtctccttccctaaggtggctcttgrgtgcagttatcatgctagggacaggtaaggaatgtcacttaatcctgggctccctgctggtccccagccaaccagcaaagggaaactcaggtgctgctaggggatgtcattgttgaagggctgcccaggaaggctgaaaacaaggatttgctttactgcatgtgtacattcattttagaagctttaaagtatttcaatggaggagcaacttagcaagttaattaggcaaattaaaaatatgtctaggaaagagagaattaatggtgaatgtggtatgagcctaatctatgcagtgggaga

SEQ ID NO: 8546 - DNA, 601 bp, Human
atagagcgagaccctgtctcaaaaaagaaaaaaagaaagccagccagataaaatgtctggctaaattgggcatctccccaagtccggctggtctgtcctgagtacagtgaagtcagctgttactgcccttccatgtggagtttgatatgagcagcaaatgatctgacacatacactctctataaagcatgcttctcagctgtctcactgccatagtacagagaaaaggtgtggcacattcggcgacgtcaggcatgaccacacagagacacagcccttgaggaacaaggtgactgttcgcwggaggcgttgctcatctgcttatctgattttagttgaattgtctggcaaggatcataacagatttaggaatttttccaaataaaaggctgggatacaaaaataggaatcattcagtgggtgagttggtatctgaagaaaacaagagaacatttaatacagaacagtcctatctatacatgtatacatagacacaaaatataatccagcaagattcacacacagcatatcactgtcatcaacagtgactctctctccctaatatagggtggaaattgggatacttatgatagaatcatgag

SEQ ID NO: 8547 - DNA, 601 bp, Human; identical to SEQ ID NO: 2885

SEQ ID NO: 8548 - DNA, 601 bp, Human; identical to SEQ ID NO: 2886

SEQ ID NO: 8549 - DNA, 601 bp, Human; identical to SEQ ID NO: 2887

SEQ ID NO: 8550 - DNA, 601 bp, Human; identical to SEQ ID NO: 2888

SEQ ID NO: 8551 - DNA, 601 bp, Human; identical to SEQ ID NO: 3339

SEQ ID NO: 8552 - DNA, 601 bp, Human; identical to SEQ ID NO: 3340

SEQ ID NO: 8553 - DNA, 601 bp, Human; identical to SEQ ID NO: 3341

SEQ ID NO: 8554 - DNA, 601 bp, Human; identical to SEQ ID NO: 3342

SEQ ID NO: 8555 - DNA, 601 bp, Human; identical to SEQ ID NO: 3343

SEQ ID NO: 8556 - DNA, 601 bp, Human; identical to SEQ ID NO: 3344

SEQ ID NO: 8557 - DNA, 601 bp, Human; identical to SEQ ID NO: 3345

SEQ ID NO: 8558 - DNA, 601 bp, Human; identical to SEQ ID NO: 3346

SEQ ID NO: 8559 - DNA, 601 bp, Human; identical to SEQ ID NO: 3347

SEQ ID NO: 8560 - DNA, 601 bp, Human; identical to SEQ ID NO: 3847

SEQ ID NO: 8561 - DNA, 601 bp, Human; identical to SEQ ID NO: 3848

SEQ ID NO: 8562 - DNA, 601 bp, Human; identical to SEQ ID NO: 3849

SEQ ID NO: 8563 - DNA, 601 bp, Human; identical to SEQ ID NO: 3850

SEQ ID NO: 8564 - DNA, 601 bp, Human; identical to SEQ ID NO: 3851

SEQ ID NO: 8565 - DNA, 601 bp, Human; identical to SEQ ID NO: 3852

SEQ ID NO: 8566 - DNA, 601 bp, Human; identical to SEQ ID NO: 3853

SEQ ID NO: 8567 - DNA, 601 bp, Human; identical to SEQ ID NO: 3854

SEQ ID NO: 8568 - DNA, 601 bp, Human
aaggaaattgaaaggttgccattgaggaaataaatgacacagcagccaaaaattggcttttctgggcaccacaccactctctaactagataagccctcacttttatctgatttggttttggtggaataacaatggtcttgaccaggtacatggactcctttttctctgctactccctaataaatacaactctaaactctgcaagtaatgaaagacacacaggaaaactctgaaaggtggaaagaggaaggcaaaatagtttgggaccccagaatcagggatcaacagagtgtccgggcatyttcagtcccccactcagcagaagaaagtgatctagtcctctgtttctcagaaccaaatctggtaacaggaggtgggtcagctaagcccattcccactctgtattgaaagggagtcctgccagcaacattaggcaagcctggtaccactggcaaggatgacctaccaggaggcctgctaccagttaggagctagaggaagtgcttctcctcccaaaccaaaagacatcagggtaggtgcggtgagagggatcagcaaaggaaccgcatgactacacgtgcccatccaggttcctctttgtt

SEQ ID NO: 8569 - DNA, 601 bp, Human
ttcttgaatatgcaaattaccaaattgcaatacaacaaacagaaatctgagtaacctctataaatataaactttgtaaatatggatgaaatgtctgtatgtgctaaagaaattgactttcctacataaactttcctacaaaaacattctacacactcagatggcatcactaatgaataattacattttaaaacagtacccttacacaaagtcttctaggttatagaaaaagagaaatgcttcccaatatacccttaagagaaaaggctttcatgtacatagctataaataaaaacacagtrtaatctcctgtgcattaataaatttaaacaggcaatacagaatgaccagtatggttttatttcagactggtttaacatttgagagaattgaaatagtttacttattaagattatgcagagaaaacatgtatcattccaactgatgccaaaataataaaaatgttacaattgataacaaaatctattagaaaaacaggaatatgataaagctgcttcaatatgagaaaggtataataaaaacgaacacactttgtaaatatggatgaaatgttgcaatctttttacctaaaataggaactg

SEQ ID NO: 8570 - DNA, 601 bp, Human
gagctaaatgatgagaacacatgggcacatagaggtaaataacagacactgtggcctacctgagggtagagggtgggggaagaaagggatcaggaaaagtaattaatgggtactaggattcatacctggatgacaaaatagtctgttcaacaaacccgtgacacgagtttaactatatagcaaacctgcataggtactccagagcttaatataaaagttaagaaaaagagaggtcaagaattggaagtgtttaactgaaatgaaataatataatattacagtcaataaacatattatattyacacgtttatacatacaattgaaaatataaataattattttaaaatttaacaaatacatatggaatgattttgatttgttacaaagtgcttgtatttaaaaatagtagtttgctgtctttatgagatactcataaaaatactcctttaacataaacataaaaaatatgaagatgaaaaatggaaaaaatataccatgcaacacaaactggtagaaaaccactttaatatactgtaataatataaaacagaagttgttattaaaaatgaagaagcatattcatagtgatatatttattatc

SEQ ID NO: 8571 - DNA, 601 bp, Human
gagattccatctaacaccagtcagaaggactattactaaaatgtcaaagacaactgatgttggcaaggctttggagaaaagggaacacttacacactgaaggtatgaatgtaaattagtccagccactgaggaaggcagtccagagatttctcagcgaacttagaactaccatttgatccaccaatcttactactgggtatatcccccaaaagacacatgcacttgcgtgttcatcacagcattcttcataatagcaaagacatggaatctccctaaatgcccatcaaggataggctggaygaagacaatgtggtacatacacaccatgaaatactaggcagtcataaaaaaagaacaagattatgtcctttgcagcaacatggatgcagtggaaggccattattctaagccaattaacacagaaacagaaaaccaaatactgcatgttctcacttataagtggagctaaatgatgagaacacatgggcacatagaggtaaataacagacactgtggcctacctgagggtagagggtgggggaagaaagggatcaggaaaagtaattaatgggtactaggattcatacctggatgacaaaa

SEQ ID NO: 8572 - DNA, 601 bp, Human
atttgcaaactatgcacttgacaaaggtccaatatccagaatctatgaggaacaattaaataatcaaataataaataatcccattaaaataggcaaaagacataacagacaattctcaaaagaagacatacaagcggccaaaaaacacatgaaaaaaatatgaaacataattatcagagaaatgcaaatcaaagctgaaatgagattccatctaacaccagtcagaaggactattactaaaatgtcaaagacaactgatgttggcaaggctttggagaaaagggaacacttacacactgawggtatgaatgtaaattagtccagccactgaggaaggcagtccagagatttctcagcgaacttagaactaccatttgatccaccaatcttactactgggtatatcccccaaaagacacatgcacttgcgtgttcatcacagcattcttcataatagcaaagacatggaatctccctaaatgcccatcaaggataggctggacgaagacaatgtggtacatacacaccatgaaatactaggcagtcataaaaaaagaacaagattatgtcctttgcagcaacatggatgcagtggaaggcca

SEQ ID NO: 8573 - DNA, 601 bp, Human
tattttgatctatacctcataccacatacaaaataagctcaacttgtgcacagcaaaagaaactttaagctcctataaacagacaacctacagaatgggaaaaatatttgcaaactatgcacttgacaaaggtccaatatccagaatctatgaggaacaattaaataatcaaataataaataatcccattaaaataggcaaaagacataacagacaattctcaaaagaagacatacaagcggccaaaaaacacatgaaaaaaatatgaaacataattatcagagaaatgcaaatcaaagcygaaatgagattccatctaacaccagtcagaaggactattactaaaatgtcaaagacaactgatgttggcaaggctttggagaaaagggaacacttacacactgaaggtatgaatgtaaattagtccagccactgaggaaggcagtccagagatttctcagcgaacttagaactaccatttgatccaccaatcttactactgggtatatcccccaaaagacacatgcacttgcgtgttcatcacagcattcttcataatagcaaagacatggaatctccctaaatgcccatcaaggatagg

SEQ ID NO: 8574 - DNA, 601 bp, Human
ttttaacaaatgtttaaacacttggctatcaatatgcacacacaaaatattttgatctatacctcataccacatacaaaataagctcaacttgtgcacagcaaaagaaactttaagctcctataaacagacaacctacagaatgggaaaaatatttgcaaactatgcacttgacaaaggtccaatatccagaatctatgaggaacaattaaataatcaaataataaataatcccattaaaataggcaaaagacataacagacaattctcaaaagaagacatacaagcggccaaaaaacacrtgaaaaaaatatgaaacataattatcagagaaatgcaaatcaaagctgaaatgagattccatctaacaccagtcagaaggactattactaaaatgtcaaagacaactgatgttggcaaggctttggagaaaagggaacacttacacactgaaggtatgaatgtaaattagtccagccactgaggaaggcagtccagagatttctcagcgaacttagaactaccatttgatccaccaatcttactactgggtatatcccccaaaagacacatgcacttgcgtgttcatcacagcattcttc

SEQ ID NO: 8575 - DNA, 601 bp, Human
aaaatggttgagatatatgatatggttaagatgtaatggctcagatgtaacatactgtatgagttcaactatatgacattctggaaaagtaaacaactatggagacagtacaaaaatcgatgcttgccatgtgtttgaaggaggaaaggatgaatgggcagagcacagaagattttcagggcaatgcaattattctgtatgatctatgatgataaagacatgtcattatcattatatatttggccagacccataaagtgtaaaacactgagtgaaacttaacataagctatggtctttcartaataatgatgtttcaattgtaacaaatataccatgctgatgggggatattgatcatgggagaagtagtgcatgagtgaggaccatgggaagtctctgtagctttctctcaattttcacaagatgtggaaccagtatataaatagatacctagattaatcaaatagactacaaagtgcaaaaatgtatccacaaatatatggaatgtagaatagttcaagaaagatgtaaaggcattcagtggagaaagtataatctttttaacaaatgtttaaacacttggctatcaatatgcacacac

SEQ ID NO: 8576 - DNA, 601 bp, Human
tatgagatatctaaagtattcaaactcatagaaacagaaagtagaatgctgattgctaggggcaaaaaggggagttgtccaatgtgtatagagtttcagttttgcaaaatgaacaaattctagaaatctgttgtaaaatgtgaatatagttaacactactgacctgttcacttaaaaatggttgagatatatgatatggttaagatgtaatggctcagatgtaacatactgtatgagttcaactatatgacattctggaaaagtaaacaactatggagacagtacaaaaatcgatgcttgccatgtgtttgaaggaggaaaggatgaatgggcagagcacagaagattttcagggcaatgcaattattctgtatgatctatgatgataaagacatgtcattatcattatatatttggccagacccataaagtgtaaaacactgagtgaaacttaacataagctatggtctttcaataataatgatgtttcaattgtaacaaatataccatgctgatgggggatattgatcatgggagaagtagtgcatgagtgaggaccatgggaagtctctgtagctttctctcaattttcacaagatgt

SEQ ID NO: 8577 - DNA, 601 bp, Human
ctgctttatttatatgagatatctaaagtattcaaactcatagaaacagaaagtagaatgctgattgctaggggcaaaaaggggagttgtccaatgtgtatagagtttcagttttgcaaaatgaacaaattctagaaatctgttgtaaaatgtgaatatagttaacactactgacctgttcacttaaaaatggttgagatatatgatatggttaagatgtaatggctcagatgtaacatactgtatgagttcaactatatgacattctggaaaagtaaacaactatggagacagtacaaaratcgatgcttgccatgtgtttgaaggaggaaaggatgaatgggcagagcacagaagattttcagggcaatgcaattattctgtatgatctatgatgataaagacatgtcattatcattatatatttggccagacccataaagtgtaaaacactgagtgaaacttaacataagctatggtctttcaataataatgatgtttcaattgtaacaaatataccatgctgatgggggatattgatcatgggagaagtagtgcatgagtgaggaccatgggaagtctctgtagctttctctcaatt

SEQ ID NO: 8578 - DNA, 601 bp, Human
ccagtcacacaaaaaaaatgctgcctgctttatttatatgagatatctaaagtattcaaactcatagaaacagaaagtagaatgctgattgctaggggcaaaaaggggagttgtccaatgtgtatagagtttcagttttgcaaaatgaacaaattctagaaatctgttgtaaaatgtgaatatagttaacactactgacctgttcacttaaaaatggttgagatatatgatatggttaagatgtaatggctcagatgtaacatactgtatgagttcaactatatgacattctggaaaagtaaacaactatggagacagtacaaaaatcgatgcttgccatgtgtttgaaggaggaaaggatgaatgggcagagcacagaagattttcagggcaatgcaattattctgtatgatctatgatgataaagacatgtcattatcattatatatttggccagacccataaagtgtaaaacactgagtgaaacttaacataagctatggtctttcaataataatgatgtttcaattgtaacaaatataccatgctgatgggggatattgatcatgggagaagtagtgcatgagtgaggaccatggga

SEQ ID NO: 8579 - DNA, 601 bp, Human
acttctggagattacagatatgtttatgacacagattattgtggtggtttcatggttatacacttatctctaatcttatcaagttgtatgcattaaatatgtacagctttttgtatgtcaatcatacttcaataaagttgtttaaacatttttaaaaaggataatatactttattttaaaaaaggaagtcttgttgcatgctgcaacatggataaatcttaaggacattatgctaagttaaataagccagtcacacaaaaaaaatgctgcctgctttatttatatgagatatctaaagtaktcaaactcatagaaacagaaagtagaatgctgattgctaggggcaaaaaggggagttgtccaatgtgtatagagtttcagttttgcaaaatgaacaaattctagaaatctgttgtaaaatgtgaatatagttaacactactgacctgttcacttaaaaatggttgagatatatgatatggttaagatgtaatggctcagatgtaacatactgtatgagttcaactatatgacattctggaaaagtaaacaactatggagacagtacaaaaatcgatgcttgccatgtgtttgaaggagga

SEQ ID NO: 8580 - DNA, 601 bp, Human
gataaagaaaatgtggcatgtgtataaaatggaatacaattctgccattaaaaagaagaaaaacctattgcaacaacatggataaacctgaaggacattatgctgagtaaaataatagtaaattcatagaagcagggagtagaagggtggttgtcaggggctgggagagggaaaaacaggagagtattagtcaaagggtacaaactttcagttatacgagatgaacaaggtctagatatctgttttactacacagaacctgtagttaataatgttgtatactaaagatttggctaagagcrtagatcttaagtgtttgtatcacaaaaaataataataaagaaggtggaaggaaacttctggagattacagatatgtttatgacacagattattgtggtggtttcatggttatacacttatctctaatcttatcaagttgtatgcattaaatatgtacagctttttgtatgtcaatcatacttcaataaagttgtttaaacatttttaaaaaggataatatactttattttaaaaaaggaagtcttgttgcatgctgcaacatggataaatcttaaggacattatgctaagttaaataagc

SEQ ID NO: 8581 - DNA, 601 bp, Human
gagatcaggaacttgaacaggtatctgcactcccatgttcattgcaacagttaaaacatagaagcaacatacaagcccattgatgaattggtggataaagaaaatgtggcatgtgtataaaatggaatacaattctgccattaaaaagaagaaaaacctattgcaacaacatggataaacctgaaggacattatgctgagtaaaataatagtaaattcatagaagcagggagtagaagggtggttgtcaggggctgggagagggaaaaacaggagagtattagtcaaagggtacaaacttkcagttatacgagatgaacaaggtctagatatctgttttactacacagaacctgtagttaataatgttgtatactaaagatttggctaagagcgtagatcttaagtgtttgtatcacaaaaaataataataaagaaggtggaaggaaacttctggagattacagatatgtttatgacacagattattgtggtggtttcatggttatacacttatctctaatcttatcaagttgtatgcattaaatatgtacagctttttgtatgtcaatcatacttcaataaagttgtttaaacattttta

SEQ ID NO: 8582 - DNA, 601 bp, Human
taataagggattaatatccagaatatattaagaacttatgtaatccaatgacaaaaaccctaataaccctatttaaaaatggacaaaggattcaaatagatatttctccaaagaagatatacaaatgtccaataagcatatgaaaagatgctcaacattactatcatcagaaaaacataaatcaaaaccactgttaaatatcacttcatacccattagcatggccgctatgaaaaaagcagaaaataacaattattgcttaggttgtgaagaaatttgggcccttgtgcactgttaatgaraatgtaaaatggtacagtcactatggaaaacattatggaggttcctcaaaaaatttaaaattgagttgacatatgaaccaacaatcttacttctgtagagccaaaggagttgagatcaggaacttgaacaggtatctgcactcccatgttcattgcaacagttaaaacatagaagcaacatacaagcccattgatgaattggtggataaagaaaatgtggcatgtgtataaaatggaatacaattctgccattaaaaagaagaaaaacctattgcaacaacatggataaacctgaaggac

SEQ ID NO: 8583 - DNA, 601 bp, Human
ttggaaggaggcaacatcaacaagatagaggaatagcataccccagcacttgctccccatagaaacaacaacttaatacatccagaaataaacgtcggtacatatggactagtgattttcaataagagtgccaagaccattcaatgggaaaagggcagtatcttccagaaatagtgttgagaaaactggctaaacatatgcaaaagagtgaaatcaaagccttacattacaccatctacaaatattaactcataatgtattgaagacttaatgataagatccaaaactgtaaaacttctasaagaaaacatgtgaggaaagcttcatgaaattggatttagcaatcatttcttgataaaacacccaaatcacagccaacaaaagcaaaaaataggcaaatgggattacatcagacttaaaaatgtctgcagagcaaatgattgaagcaacaaaatcatgtatctaataagggattaatatccagaatatattaagaacttatgtaatccaatgacaaaaaccctaataaccctatttaaaaatggacaaaggattcaaatagatatttctccaaagaagatatacaaatgtccaataagca

SEQ ID NO: 8584 - DNA, 601 bp, Human
tactattctagattggaaggaggcaacatcaacaagatagaggaatagcataccccagcacttgctccccatagaaacaacaacttaatacatccagaaataaacgtcggtacatatggactagtgattttcaataagagtgccaagaccattcaatgggaaaagggcagtatcttccagaaatagtgttgagaaaactggctaaacatatgcaaaagagtgaaatcaaagccttacattacaccatctacaaatattaactcataatgtattgaagacttaatgataagatccaaaactrtaaaacttctagaagaaaacatgtgaggaaagcttcatgaaattggatttagcaatcatttcttgataaaacacccaaatcacagccaacaaaagcaaaaaataggcaaatgggattacatcagacttaaaaatgtctgcagagcaaatgattgaagcaacaaaatcatgtatctaataagggattaatatccagaatatattaagaacttatgtaatccaatgacaaaaaccctaataaccctatttaaaaatggacaaaggattcaaatagatatttctccaaagaagatatacaaat

SEQ ID NO: 8585 - DNA, 601 bp, Human
gagtaacagttgcagtttttacagctgggggaaaatcaacagtgttttttgccacaaggacagacttgattagcggtcagaggttggggcatagtgtaacagaccactgcttttcaactgaaagtgctgaattttgcaggaaatgaatgagaaaaccccattttttgttgttttttattttttttagtctgaggtgtagtctcctctggggcaagaacagtgccagccataaatataacaaaatcctaaacatgagagtgcaatagacctcatgacattagccctctacatattctttaawtttttttttaaattgacacattgtaattgtacatatttatggggtacaacttgatgttcaatacatatatatgttacattaaataatcaaatcagggtatttagtgtatctgtctacctcatgtatttatcatttctttgtggtgagaacgttcaaaagcctctgttctagctattttgtaatatgcaatatcttactgttaaccatcatcaccctactatgcaatagaacagaacttattcctcctacctaactataactttgtacccattgaccaagctctcaccctgtccccctctt

SEQ ID NO: 8586 - DNA, 601 bp, Human
tgcctgtaatccctcacgcctacaatccctcacgcctgtaatctcagcagtttgggaggccgaggtggacagattgcttgcggtaaggagtttgagaccagcgtagccaacatggcgaaaccccatctctacgaaaaattagccaggcatggtggtgagtgcctgtagtcccagctacttcggaggtggaggccgaagaattgcttgagcctggaaggctgagatctcagtgagccgagactgccactgcacgggtgacagagcgagcctctgtctcaaagaaagaaagagtatgtacctrgatatgtatttttaaaataatgtaaagatttaaaaatagttcgaagaacctaattgtatggcttttgaagcaactagaagtatgttctttacagatggtgggagtaatgttatattaagtttgtgtaagctataacacttaagtgtttataagcatgtttataagctggtgtttacaagcatgtttttatttccgaacaaaattcaaaagaagtttgtctttgtaaaaattcagatgtgcacagttcttgttcctctctgaagatattggaaatgtattgctaatactggtaatatataa

SEQ ID NO: 8587 - DNA, 601 bp, Human
gaaattaattcatcgtggaaatattcattttattcagcacttagaaataacagttcttgataatattatgatttataatttatacatggtgtattttaatgaattgcaggtgtttaagaaataagtaacatagcagggcgcggtggctcatgcctgtaatccctcacgcctacaatccctcacgcctgtaatctcagcagtttgggaggccgaggtggacagattgcttgcggtaaggagtttgagaccagcgtagccaacatggcgaaaccccatctctacgaaaaattagccaggcatrgtggtgagtgcctgtagtcccagctacttcggaggtggaggccgaagaattgcttgagcctggaaggctgagatctcagtgagccgagactgccactgcacgggtgacagagcgagcctctgtctcaaagaaagaaagagtatgtacctggatatgtatttttaaaataatgtaaagatttaaaaatagttcgaagaacctaattgtatggcttttgaagcaactagaagtatgttctttacagatggtgggagtaatgttatattaagtttgtgtaagctataacacttaagtgtttat

SEQ ID NO: 8588 - DNA, 601 bp, Human
cactctggaatgaaaactcttcctcctggccagtcacagcgtgagatccatcctcgccaatttcaacttgctagttttagaactgccctgtcctagggccacccacaattgttgaattgtcattttaaacaccttcaaagactagaagaaattaattcatcgtggaaatattcattttattcagcacttagaaataacagttcttgataatattatgatttataatttatacatggtgtattttaatgaattgcaggtgtttaagaaataagtaacatagcagggcgcggtggctcatgcytgtaatccctcacgcctacaatccctcacgcctgtaatctcagcagtttgggaggccgaggtggacagattgcttgcggtaaggagtttgagaccagcgtagccaacatggcgaaaccccatctctacgaaaaattagccaggcatggtggtgagtgcctgtagtcccagctacttcggaggtggaggccgaagaattgcttgagcctggaaggctgagatctcagtgagccgagactgccactgcacgggtgacagagcgagcctctgtctcaaagaaagaaagagtatgtacctggat

SEQ ID NO: 8589 - DNA, 601 bp, Human
atatagggataagacagcatttttcttcctaaggaaaatggctcattaattgtagaaatgagtgaagcaaggtgtctcaagtcacgtttttttccctcttacgtacctattagcaggtgctcaaattttagttgacttatttctccttcctttatccccagtagcttcatttgtgtgcaaaggaataaaaaatgcaagtggttaaaagtctacaacgcttgcattatattttggcgaatataaaaatcactactaaaatcttacaatgttcctcttgaggtcttagccaagaggtcctggygtttttctgcactgtaataatgttgtcttcataatttgacatagaagtaatagtaccaaagcttaacaaaaataagtaaataggaaattactgatattttcataatatcattctatatttatttattgagcttttatctattatggagcaagcatattgtttggccatgaataaacaaagttcaataaagtataaagcacagttcctatcatctagttgtccacactctatttaaggcatacacagaagcagatggttttaaattagtatgtaattcacaacggtagacacaaactctgg

SEQ ID NO: 8590 - DNA, 601 bp, Human
tatctttataattgtgcataaatagccatacataaatagtaactttaaacaattgctctcaagtaagtcacatgcatgatttgcaggtcagatgacatcatattttttattagcatcctggttacttttctctgattgcttatttgattgccattaaaccttccatttcctgctatagtgataatctccacattcatagatggaacgatgcctttaacgacttctgcatcttggattcaaatggattttgtgtttacttcagtgcttcaaatatcaaagaagtctagaattttgaagatgwcttaaatttgtgacattacttaccacaagtgcctaaagacacagatatagggataagacagcatttttcttcctaaggaaaatggctcattaattgtagaaatgagtgaagcaaggtgtctcaagtcacgtttttttccctcttacgtacctattagcaggtgctcaaattttagttgacttatttctccttcctttatccccagtagcttcatttgtgtgcaaaggaataaaaaatgcaagtggttaaaagtctacaacgcttgcattatattttggcgaatataaaaatcactactaa

SEQ ID NO: 8591 - DNA, 601 bp, Human
tagcaaatatttgtgttatattaacttaatccatgctaggacacaccattgttttgattgtttaattgcaatctatatggtataatggaacagaaaagtgtttttcccactctggtattatctttataattgtgcataaatagccatacataaatagtaactttaaacaattgctctcaagtaagtcacatgcatgatttgcaggtcagatgacatcatattttttattagcatcctggttacttttctctgattgcttatttgattgccattaaaccttccatttcctgctatagtgatratctccacattcatagatggaacgatgcctttaacgacttctgcatcttggattcaaatggattttgtgtttacttcagtgcttcaaatatcaaagaagtctagaattttgaagatgtcttaaatttgtgacattacttaccacaagtgcctaaagacacagatatagggataagacagcatttttcttcctaaggaaaatggctcattaattgtagaaatgagtgaagcaaggtgtctcaagtcacgtttttttccctcttacgtacctattagcaggtgctcaaattttagttgactt

SEQ ID NO: 8592 - DNA, 601 bp, Human
ccttttggtaaatgtgtttgaattgacaaaagacatgtcaaaaaggacaaatttttaaaattcacatggacaataaagaaaataaaaaggagtggaagaaatagagctgagtctttggatatgcaggggcatctatggccacaccaccatgatgcatccagtctcgtctggacacgcatgggcatattgaagcagaagtgaaatgatgactaatgtaaaagtaaaaaagtctgcaaacatattttaagaaatatgtatatatatattttcagaacctattttccattcagctaggtattawgtactgggctacacatactgacatataatgttaactggtgtattgtaattatatgaactcaaggcagagattccataaatctggaatttatactttggggaaaaacaggtcatcatcttggcaattaattaattttctctggcacagcttcctaagccaggaatgattaaatgatttttttgccccatctcagttgaaattttgtataattctaaaatttagcaattcaattgaaatatctttagcaaatatttgtgttatattaacttaatccatgctaggacacaccattgttttgat

SEQ ID NO: 8593 - DNA, 601 bp, Human
attgattgcgcatgtaatacctaactcagttattttacatatggagtaaagagagtaggtatcactttatggatgaagaaattgaatgctagagatggccaaaatcataaagcttatttaatataatgttaccaactgtgaataagttataaatttataaacacctttaggataaaaagtgctttaacatacatgtcagttgatttgaatattacacaaatctaagataaatatggaatgtttcatgcctgtatttgatagaaaaagaaactaaactaaactacacagaggttgcaaattracccttcaaatctagagagcggtaaaagtttgagtaaaattcaagtctgactccacatctatttcactatttcaagctgtcccaagttgtgagcgactttaccataatatagttaataaaataaagggaaaaaagtttttaagttttggaagacttgatttaaaatacaatatgaacataacatgaaatcaacataaatagaacatgaaaagaatcagagtaaattgcttgcctatgccttatatgcttgtatgaaattcttggtatcttaaaattgtataaaaacaaaactacacactt

SEQ ID NO: 8594 - DNA, 601 bp, Human
tctatagcactgtagggagagtactgttaagagtaatttattgtatattttcagatagctagaagagaaggttttgaatgttcccaacacaaagaagtgataaatgttgaggtgatgggtgtgctaattaccttgatttggtcattagacattgtatagttgaatggaaatatcactgtatcccataaatatgtataattattacatgccaactaaaaataaacaaaaattaccgttccccttaactacatattaaaaatacattttaaagaaactataatacacaaaatatcctatgaatttttttttttttttacctaagacaatatcctggtgattagtcctcatggcgtataaggataccaaatttataaatagctgcattgtatttcactgacaactctggacagatctaatttttgacggactgtcaatttttttttccagtggatatttaaattgtttcttaggtcttgctatgagaaataatgatacatttcatacccatctgtgcatatttttgagtctctctctgggataaattcccacaatgataattgttgagggaaagggcatgtgtgttttaaattttggtaacaat

SEQ ID NO: 8595 - DNA, 601 bp, Human
ttccatttgtaatacctacaaataataaaataccctggaataaatttaatcacacaagtgaaagacctctacaatgaaaactgtaaaatactgatgaatgaaaccaaagaggatgcaaaaaaatggaaagacatctcatgttcatagacagaaagaatattgttaaagtaatcatatgactcaaagcaatctacagattcagtgcaattcctaacacgataccagtaacattctctacagaaatagaaaaatatcttaaaatttatatggtaccacaaaaggctgaatagccaaagcaatyttgaacaaaaatgaagaaaactggtggcatcacgttacctgacttcaatatatacgacaaaactacaacaaccaaaacagtatggcattgatataaaaatagacacctagaccaataaaacagaatagacaacccaggaataaatccatgtattatagccaactgatttttccagaaagtcaccaataacatacactgggaaaggagagcctcttcaataaatgaagctgaaaaaactggatatccacatagaggaatgaaattagaccctcatctcacaccatatacaaaaatcaactc

SEQ ID NO: 8596 - DNA, 601 bp, Human
aaagaaatcaagaagtcaattccatttgtaatacctacaaataataaaataccctggaataaatttaatcacacaagtgaaagacctctacaatgaaaactgtaaaatactgatgaatgaaaccaaagaggatgcaaaaaaatggaaagacatctcatgttcatagacagaaagaatattgttaaagtaatcatatgactcaaagcaatctacagattcagtgcaattcctaacacgataccagtaacattctctacagaaatagaaaaatatcttaaaatttatatggtaccacaaaagrctgaatagccaaagcaattttgaacaaaaatgaagaaaactggtggcatcacgttacctgacttcaatatatacgacaaaactacaacaaccaaaacagtatggcattgatataaaaatagacacctagaccaataaaacagaatagacaacccaggaataaatccatgtattatagccaactgatttttccagaaagtcaccaataacatacactgggaaaggagagcctcttcaataaatgaagctgaaaaaactggatatccacatagaggaatgaaattagaccctcatctcacac

SEQ ID NO: 8597 - DNA, 601 bp, Human
cccactttgctcataaaaacacacatagactgactgtatagggatgaaaacagatattccatgaaaatgaaaaccagtaaagagcaggcacagctatacttagataaaatagactttaagtcaaaaagagtaaaaaagagtcaaagaagaccattatataatgacaaatgggtcacttcagcaatataatatagtatttataagtatacatatgcacccaatattacagcactcagatatattaagtaaatattaatagatctgaagggagaaatagatgaatacaataagggcaggggarttcaacaacacattttaagcaatggacagatcattcaggcagaaaatcataaaagaaacatcagagtaaaactataatatagacctaacgaacctaactaaatgtacagaacatttcatccaactgctgcaaaatacacattcttcttatcagcacatggaacattcatcaggacagaccatatgctaggtgataagtctcaaaacatttccaaaagtcaatattatatcaagtaaattttctgacaacaatggaataaaactagaaattgataacgaggaactttggaaactgcacaga

SEQ ID NO: 8598 - DNA, 601 bp, Human
caagttaaaactacattcatataccaaaacacatcatttagtgtgtctgaaatttacttatttatttatttatttatttatttatgagacagggtcttgctctgtcactcaggctggagtgcagcggcgcaatctcggctcactgcaacctccgtctcccgggttcaagccattcccctgcctcagcctcccgagtagctgggattacagacacctgccaccccgtccagctaatttttgtatttttagtagagacagggtttcactgcattggccaggttggtcttgaactcatgacctsaagtgatctgcctgcctcggcctcccaaagtgctgggattataggcataaaccactgcacccagccagtataaaatttaagaggctgatcaaaacaagtgttgactaggatgtgaagcaacttctctgtcagattttctcttacatactgctaggtagaaagtaaaatttgtaaaatatcatcaccactttggataacagtgtggcactttaaaaaaagttaagtatatacttatatgattcagccattttgtttctaggtgtttatgttaagggaaagaaagatttcgttaatatgata

SEQ ID NO: 8599 - DNA, 601 bp, Human
atatgacgggatgttgccaaatcatctcacatattaatagtataacttttattagaaaaaaaggtttcaaatcaacatatcagctttcaatataagaaactaaaaaagcaaatttaacctactataagaagacagtaaataataaagatcaaagcagaaatcagtgagaagaaaatttttacctaaatggcaaataagcacacacaaaaaaatgctacttaacatcattgcattagtaaaatgcaagttaaaactacattcatataccaaaacacatcatttagtgtgtctgaaatttacatatttatttatttatttatttatttatgagacagggtcttgctctgtcactcaggctggagtgcagcggcgcaatctcggctcactgcaacctccgtctcccgggttcaagccattcccctgcctcagcctcccgagtagctgggattacagacacctgccaccccgtccagctaatttttgtatttttagtagagacagggtttcactgcattggccaggttggtcttgaactcatgacctcaagtgatctgcctgcctcggcctcccaaagtgctgggattataggcataaaccactg

SEQ ID NO: 8600 - DNA, 601 bp, Human
aggttatcacatagaatacatagaaaacagcagaataaacatttctgatcaaatacacctaaaacatttttaaaaacacactatagtctagtccataacaaacactgatgtcaataaatttaagttttaaattatacaaaataattcgctaatgaaaatgaaattaaattagaaatcaataataaaaatgtctgaaaaattcacaaatgttgaaaactaaatgacacatgtaaataaccaatgaatcaaagaatgcaaaagacaatttagaaactatttttaactgaatggaaacaaaaartagtatctcaaaatatgacgggatgttgccaaatcatctcacatattaatagtataacttttattagaaaaaaaggtttcaaatcaacatatcagctttcaatataagaaactaaaaaagcaaatttaacctactataagaagacagtaaataataaagatcaaagcagaaatcagtgagaagaaaatttttacctaaatggcaaataagcacacacaaaaaaatgctacttaacatcattgcattagtaaaatgcaagttaaaactacattcatataccaaaacacatcatttagtgtg

SEQ ID NO: 8601 - DNA, 601 bp, Human
tttcgtaagtagctgggattacaggcatgtgccaccacatccggctaatttttttatttttagtagagatggtgtttcactacgttgccaggctggttataaactcctgacctaaagcaatacacccacctcggcctcccaaagtgctgggattacaggtgtgagccactgcacccggccccagctgagattttttaataactgctcttactaggttcagtctacattagagtctcgttctttttttctttctttcctctctctcttttttttttttttgacagtgttttgctcttgtcasccaggctggagtgcagtggcgcaatctcggctcactgcaacctccacctcctgggttcaagcaattctgctgcccctcagcctcaggagtagctggggttacaggcacttgccaccacatctggctaatttttgtatttttagtaaagatgagctttcaccatgttggccaagctggacttgaactcctgacctcaggtcctcccaaagtgctgggatcacaggcgtgagccactgcacccggcctcattctttttaatatcactttgtccatgtgttccttcgatttctttctctgttt

SEQ ID NO: 8602 - DNA, 601 bp, Human
aaaatttcaaatctaatacatacatacacacattcacaagtgtgtataagtgtgtgtgtgtgtgtgtgcatatgtttaggcattccatgtggagatttctatatctatatatgtgttttactctggcatctttaatcttttggagttatatgattaataatgatactttgttttctttcataagagatgggaaatagaaagctcaagaaagagtgaggatgtcacttcaatgtaaaattgacaaaaaaataaaaagattatggtctgatgctatccctatttaaaaagacgatgtaatgayctctgttctgtaactgaacaatcggccactgtagggagaaaactattcttaaagagtttttgttttgttgtttgtttgtttttagacagaatcttgctccgctgccaaggctggagtgcactggttcaatctcggctcactgcaaactctgcctcccaagttcaagtgattctcctgtgtcagtttcgtaagtagctgggattacaggcatgtgccaccacatccggctaatttttttatttttagtagagatggtgtttcactacgttgccaggctggttataaactcctgacctaaag

SEQ ID NO: 8603 - DNA, 601 bp, Human
aaatgaaaataaaatttcaaatctaatacatacatacacacattcacaagtgtgtataagtgtgtgtgtgtgtgtgtgcatatgtttaggcattccatgtggagatttctatatctatatatgtgttttactctggcatctttaatcttttggagttatatgattaataatgatactttgttttctttcataagagatgggaaatagaaagctcaagaaagagtgaggatgtcacttcaatgtaaaattgacaaaaaaataaaaagattatggtctgatgctatccctatttaaaaagacratgtaatgacctctgttctgtaactgaacaatcggccactgtagggagaaaactattcttaaagagtttttgttttgttgtttgtttgtttttagacagaatcttgctccgctgccaaggctggagtgcactggttcaatctcggctcactgcaaactctgcctcccaagttcaagtgattctcctgtgtcagtttcgtaagtagctgggattacaggcatgtgccaccacatccggctaatttttttatttttagtagagatggtgtttcactacgttgccaggctggttataaactcc

SEQ ID NO: 8604 - DNA, 601 bp, Human
atggatattactattccaaaaggaagaaagagaggaagagaaacagtcatgggactcaagcaagtacaaatcatagcaaaggaaacgtcctaagatcttacttaaggctggagaataatgcctttaagataatcatggcccactggggcagcaccacctccctgaccccgttgggtggaggacccattaaaagtggcagcatgacccccacaggcagggaaggcactgcccatgctgtgtctctctgctgtggccctgcccatgaggcaatttcctgtggagggtggggttgcactctcastgatctgctggccttctcttccttcactgatcccctgggtgttggtcctacctttagaaattaaaacagcacccctcccccagcccatccactctgggcttgtggtgggagaggcagccttggggatatctgaattgcctttaggatctctcttcttttgtcttggagaatcatgcatgtttgcagtgaaattgttctatggtttggtcctgtggagtctaagaaatctgacagtctttggtcattttgtcctgtttttgtttgtttcctttagtctcggttggcagtgttaccgctggt

SEQ ID NO: 8605 - DNA, 601 bp, Human; identical to SEQ ID NO: 3555

SEQ ID NO: 8606 - DNA, 601 bp, Human; identical to SEQ ID NO: 3556

SEQ ID NO: 8607 - DNA, 601 bp, Human; identical to SEQ ID NO: 3557

SEQ ID NO: 8608 - DNA, 601 bp, Human; identical to SEQ ID NO: 3558

SEQ ID NO: 8609 - DNA, 601 bp, Human; identical to SEQ ID NO: 3559

SEQ ID NO: 8610 - DNA, 601 bp, Human
ggaggaaactgagctgtggacattagataacttgtctaaggccatctagccacagcctcctggccactacatgctaatgtgcttgcaagctgtaatatgtgtgcagctggaaggatggtggcattatttcatacactcccgatgccggatcctgcacagatcccatggcattggttcagaaatataggtcagcaaatgtaattctgtggatttggagcccaatgagccagagcccccacctgagcctctatggctggggcaggaagctgccaggctggcccagcagcaggatctgtggacsaagttagtgccactaatgggccatgtgggcagaatagcacctcacacctctcttatttacagattcctatttttaaatgaaatcagaggtaaacaaaaacactgctggggaaaacaatacactagagcaatggccaattaatgtacttgtctgcactcagagaaattatttttaacgtcattttccaatagatttagttgtctttacaagttcatgaaaaagtaatttaacagagcagaatctgtttaagacgcacctacacaatcagcttttagaaaaacttaatgacaaatttggtag

SEQ ID NO: 8611 - DNA, 601 bp, Human
agtaactagggaacacaccccagttcatgagctgcgaagtggaagaaaccgttctcaaatgcagctccaccactcaatggccatggaaacttcagcaagttaattaaactctgaactccctttcttcatctgtaaaataaatgatgattcctttcaggtctgctctgtcacagtaggattaagaagataaacacaaataacactaacaagtgacttctgaaatcagggactatggactatgtgctttacctgctgctatggtttggatatttgatcctaatgttggaggtggggcctaatkcgaggtgtttgagtcatgggtgtagatccctcatgaatggcttggtgccatctcagtagtgaatgggttctcactttgttagttcccatgagaactggttttaaaaggaagctggcaccacccccttcagcttcctctctctccacgtgatctgcacctgcctgctccctatcaccttccgccgccgtgactggaagcagcctgaggctgtcaccagatgcccagtcttgaatcttacagctcatagcagagccgtgagctaaataaaccttttttcttcataaattgcccagcctcaag

SEQ ID NO: 8612 - DNA, 601 bp, Human
aggtcataatggcctgcactggggtggtggcagaaggaaatgtacgagggagacagaaaaggcatttatttatttacttatttactgagacagaatctcattctgtcgtctaggctggagtgcagtggcacaatcttggctcactgcaacccctgcctcccaggttcaagtgactcttgtgcctcagcctccagagtagctgggattacaggtgtgtaccaccacacctggctaatttttgtatttttactagagacggggtttcgccatattggccaggctggtctcgaactcctgaccrtaagtgatccgcccatcttggcctcccaaagtgctgggattacaggcatgagccacagcgcccagccaggagaggcgtttaaacaaaggggcagacactggaggaggagcaggaagaaagagggaaggaagcaaacatgacttagtggtggtctcagtgtgggtaacccacatcatcttatataattcatcctcaccacactgggaaaggtgggacaggaactattatcactaatttacaaatgagaaaagtgggaattagggaggttaagtgatttaccaaggtttccctactatgagt

SEQ ID NO: 8613 - DNA, 601 bp, Human
gcaggaacggtgaggctaaggaggaaggcttgaagggaggcaggcctgggaggaggggagccatctccccaaacaaggatgggggtgagccttgcctggcagacttctttctggaaccaatgcacctaggcaggaaatgtgacctgtgtgcagagaagcaaagctgcccttctgaccacaactaggggttagagtgggtggggggccaggaaagaagctgcccaccagttccagaaggcagaggagagatgctgacgtaagcatgagttttgttaggcaaaagagagaagacaaagaatarggtcaagcgaggctctgggaatgttactcaaacggagagaaagagaatctggggctcttataccagttgaagaataaggtcataatggcctgcactggggtggtggcagaaggaaatgtacgagggagacagaaaaggcatttatttatttacttatttactgagacagaatctcattctgtcgtctaggctggagtgcagtggcacaatcttggctcactgcaacccctgcctcccaggttcaagtgactcttgtgcctcagcctccagagtagctgggattacaggtgtgtaccacca

SEQ ID NO: 8614 - DNA, 601 bp, Human
tgaaccaatttactgtttgaatgggtaaaaaagacattcaagagatggctttaaaaaatataagaacggttgtcaaagaaaaaagatgtcttacagtttagaaaaatcagtaagtaaagactgtcaagcttcagttcaagtcaagagcttctgccaatacatcagtacatctgtcacagggtgatgtgatatttagtgttccatgtggcattttacaatttttacatggccaaagcagcaaaacttttattattacttatatagaagagctttatagaatgcatgagaaggggcagtgtawtaaaggagtgcaattcagcatggcttgggataggaaggtgcttcaacacacccatgggcctggtcagtgcagagccggcttacaagagaagcagtttctccaaagggatttgcaagccaaggtgtaaattcaataaccagcaataacgaagcagcacccggaagccagagatgaaaccttaaagaaacatcatacgagacactagaagagccttccagacttttaaaataaagaagagaaaacaaagcctgtgaatgtttaggaagggaataagatctgggagagcagcatgagcagatg

SEQ ID NO: 8615 - DNA, 601 bp, Human
caccaccctgtaaactcagacactggattcagtcctcctgttcccaagtttcccaagtagaactcactttctgtaacccaacattttagaacagaaaaatgaaaacacatagccaggagtgtgagtcacttttttgcaggttaaatcttaaaagttctcttggacttgtttttcactgttttgtcaatatgatgaaagattttgaaagaaggaggaaagtgcgctgtgaccctgctgctaactctagtctcaatctcctggcatgaggcccgtcttcctcctgcaacgcccacctctgcckcacgctgccatcccaggggaacgcagcttcatgttccacaccttttccttcctatgaaagatatttttctgtatggctactgactagtagtctggtattttaataactgcaaaatgaatacatctcaattacggaaagacaataaacaccaaaacaatcctgcttaaaataaggacgcctccctcatacctgtcgagatgctgctagatgagtccccaaaactccatccttctcaaagaggtacagtcgtctttacaactgtgttccttagctctggatttcaacagactgggttcatat

SEQ ID NO: 8616 - DNA, 601 bp, Human
aaaaagcccagaagtggatatcaaagccaagcaatttataactggttggtcagtgacacttgaagtggccttgtaggagagtgctcctacagaagggtctacactatatttaaattgcccaaaacattgtctgtccaaaattcagagaattttaatgcaagatgcacactgggcagggaaggtagtgagaaaaaaaaggtagcagaaaagagggcagagtgaagctcagtcaccattcctgccagcaccattcctatggcaggaaggtgggatgccagcaccgagggcacgggcaccagcrctgcagggttttccaatgagatccacgagcgtcctcagcaaatcccattgcctggggcaacctaaatgccttcctccactccagtctacatccccatacccctcagcattcttgcaagaactagaagtaatcttcacaaagtgcctggcaaatcaaagcacttaatagtagccatttttggttataaacaaaccattgcaataaacataaaattagaaatagtgcttgaaaatggcctgttgctttaaaaatggacaacaaatatccaccgaaaccagtatttgttgaattaaaaatctt

SEQ ID NO: 8617 - DNA, 601 bp, Human
ttctttgagacccaacagtatagattcaaattctcttcaataatttttggatgcgtgtctctgtgaatgtgacctaggtgtctgagctgaaccagatgggattctggggtggttttgttttgctttgttttcaactattttatttttaattctggtaagaaatacataacataaaatgtgccatcttactcatttgtaagtgcacagtgcagtggtgttgagtatatttacattgttgtgcaaccaatagccagaatttttcatcttgcaaaactaaaaccttatacctattaaatacaayatcccatttaccccatccccagcccctggcaactaccattctactttctgtttctatcaatgtgaccactttagatattttatataaatgaagtcatatagtatttgtcttcctacgactggtttatttcacttagcataatgtcctcagaatgtctttccttttggagactgaataatattccattgtgtgtatatatggggtcctggtatatattggttccattaaaaagggctttacatttatatcaagtagtaaaataaatcaacttagtccttaatttctccttgtcaagtccct

SEQ ID NO: 8618 - DNA, 601 bp, Human; identical to SEQ ID NO: 2546

SEQ ID NO: 8619 - DNA, 601 bp, Human; identical to SEQ ID NO: 2547

SEQ ID NO: 8620 - DNA, 601 bp, Human; identical to SEQ ID NO: 2548

SEQ ID NO: 8621 - DNA, 601 bp, Human; identical to SEQ ID NO: 2549

SEQ ID NO: 8622 - DNA, 601 bp, Human; identical to SEQ ID NO: 2550

SEQ ID NO: 8623 - DNA, 601 bp, Human; identical to SEQ ID NO: 2551

SEQ ID NO: 8624 - DNA, 601 bp, Human; identical to SEQ ID NO: 2552

SEQ ID NO: 8625 - DNA, 601 bp, Human; identical to SEQ ID NO: 2553

SEQ ID NO: 8626 - DNA, 601 bp, Human; identical to SEQ ID NO: 2554

SEQ ID NO: 8627 - DNA, 601 bp, Human; identical to SEQ ID NO: 2555

SEQ ID NO: 8628 - DNA, 601 bp, Human; identical to SEQ ID NO: 3378

SEQ ID NO: 8629 - DNA, 601 bp, Human; identical to SEQ ID NO: 946

SEQ ID NO: 8630 - DNA, 601 bp, Human
tctagtttatccccagctataggttcttcctttacatctccatgtaaacttactgaatttcttatttcttattatttttttctgtgcatgcccagaggctcaagaaatgagcctttctatctttctacctttactatcgccaaggtaagctgggtagtccaggtgcatgactgaccttggctaaagagtatgtttgctttacttttaactaatttaactcatagagaaacttgatctcaaatgtcctctggaatgacatttgtttaaaaaacatgacctctggttcttttcagatttaaasaaagcaattataaaaaagaaagacaaagaaatggttatagtctgagttacatatttttatgcatgaaattgtaattttgttggaaacatgattaacaattttgaaatattaagattgaaaatgaaatcatcatattactcacctttaagcagagtttgtggtgtcctcggacctaagctgcaaattattggggaaaaaataggtatgcagaatgaagagggtatatatgttaatccaaacaaagcttcttttcttattgctagctaacacaaggcaatgctgtcatatcccagaagccta

SEQ ID NO: 8631 - DNA, 601 bp, Human
atctcagctcactataaactcagcctcctgggttcaagcaattctctgcctcagcctcccgagtagctgggattacaggcccctgccaccacacccagctaatttttgtatttttagtgaactcggggtttcaccattttggtcaggctcgtcttgaactcctgaccttgtgattcacctgcctcggcctcccaaagtgctgggattacaagcgtgagccaccaagcccagcaacaatttttaatcaaataaaaataattacttctctgaatttttttgttatgatggcctagcatattgkattatatggtttcttatttattaatttccacatctctaggcattctggaggtatctaaaattacacacaggcattttacccattactgtacaattttcatacaaacatagaataaaagaatgttcggtcaatagaggaagataggaaaaaagtcttccacttcagtgccatcgtagaaaagcagaaattcttcagttttctcatagttgccatcccctcttgagttttccaaaaatcagtgatcccattgaaccattgatgatagctttatgagcatttagagaatttcaattaaaatga

SEQ ID NO: 8632 - DNA, 601 bp, Human
aacagaacccttataaaatattctgatcgctctttaagctataactgttctgaggcaatatggagcctgatataaattaagatggtaacattaaaacttatttgatgaggtactaatgaaagagctaattggtagcttttcttttttaatattctattattaggaatacaaattgttttatgttaaaacaattttatttttatttatttatttttttgagacagagtttcattctttcacccaggctggactgcagtggcaggatctcagctcactataaactcagcctcctgggttcaarcaattctctgcctcagcctcccgagtagctgggattacaggcccctgccaccacacccagctaatttttgtatttttagtgaactcggggtttcaccattttggtcaggctcgtcttgaactcctgaccttgtgattcacctgcctcggcctcccaaagtgctgggattacaagcgtgagccaccaagcccagcaacaatttttaatcaaataaaaataattacttctctgaatttttttgttatgatggcctagcatattgtattatatggtttcttatttattaatttccacatctct

SEQ ID NO: 8633 - DNA, 601 bp, Human
cttctcaaaagaagacatttatgcagccaacagagatatgaaaaaaatgctcatcatcgctggccatcagagaaatgcagatcaaaaccacagtgagataccatctcacaccagttagaatggcgatcattaaaaagtgaggaaacaacaggtgctggagaggatgtggagaaataggaacattttacactgttggtgggactgtaaactagttcaaccattgtggaaggcagtgtggtgattcctccaggatctagaactagaaataccatttgacccagccatcctgttactgggtatmtacccaaaggattataaatcatgctgctataaagacacatacatacatatgtttattgtggcactattcacaatagcaaaaacttggaaccaacccaaatgtccatcaatgatagactggattaagaaaatgtggcacatatacaccatggaatactatgtagccataaaaaatgatgagttcatatcctttgtagggacatggatgaagttggaaaccatcattttgagcaaactatcacaaggacagaaaaccaaacactgaatgttctcacttataggtgggaattgaacaatgaga

SEQ ID NO: 8634 - DNA, 601 bp, Human
aatatggctctctcatgtcccagaggatgagtttctgattatatttctacgtgattagtttacgtttcttagttttcatgaaaggatacctcagtaaaaataaatggggttcatcatttcataaatcttggtttaagtcaagagcttgagatcagatataaaaattgttttttcagtatgttcagaaactagggtatttcttgttaataaatcagtaagctttttttttttctttttttttttttttttgagatggagtctcactctgtcacccaggctagagtgcagtggtgtgatctcrgctcactgcaagctctgcctcccgggttcatgccattctcctgcctcagcctcctgaggaggtgggactacaggtgctcaccaccacatccagctaattttttgaatttttagtagagacggggtttcactgcgttagccagggtggtctcgatctcctgacctcgtgatcagcccacctcggcctcccaaagtgctgggattatcagtaagctttttaaactcttctacaagctcaaagaaaaatgccagaataaaagtaaccaaatccattgacgtatggctgaatatgtctttcaat

SEQ ID NO: 8635 - DNA, 601 bp, Human
agcccttcactgagtttctaacaatcctaagtactgtgttactgcagtatcaagatgcctggagctccaccactcaggccacaacaggttgagcggaaaaatctttgaccagtggttcccacttatggtcttgaagatccatgagttatttgcaaaaccatacccaccccgttattgccagtttaatcgttatatccctaatgaaacatgcaacattattaatatatgcatacatatcaataattctgctgtaattaatatagtagtaacttttactttaaaaagttaaatgccattcgcytaatttttctgtctcagtttcactatctataaaataagagtaatacctacctcataaagcttttgttaggattcagtaagaaggttcatgtaaactgcttagaacaattattggcatagaatcatcacttaataaatactagcttttcaaattagtaataacttttaagaatgttacaaatttaatagtagctgttggtcacacatttttaatagatatttccaaattgccctgctaaaatatggctctctcatgtcccagaggatgagtttctgattatatttctacgtgattagttta

SEQ ID NO: 8636 - DNA, 601 bp, Human; identical to SEQ ID NO: 947

SEQ ID NO: 8637 - DNA, 601 bp, Human; identical to SEQ ID NO: 948

SEQ ID NO: 8638 - DNA, 601 bp, Human; identical to SEQ ID NO: 949

SEQ ID NO: 8639 - DNA, 601 bp, Human; identical to SEQ ID NO: 950

SEQ ID NO: 8640 - DNA, 601 bp, Human; identical to SEQ ID NO: 951

SEQ ID NO: 8641 - DNA, 601 bp, Human; identical to SEQ ID NO: 952

SEQ ID NO: 8642 - DNA, 601 bp, Human; identical to SEQ ID NO: 953

SEQ ID NO: 8643 - DNA, 601 bp, Human; identical to SEQ ID NO: 954

SEQ ID NO: 8644 - DNA, 601 bp, Human; identical to SEQ ID NO: 955

SEQ ID NO: 8645 - DNA, 601 bp, Human; identical to SEQ ID NO: 956

SEQ ID NO: 8646 - DNA, 601 bp, Human; identical to SEQ ID NO: 957

SEQ ID NO: 8647 - DNA, 601 bp, Human; identical to SEQ ID NO: 958

SEQ ID NO: 8648 - DNA, 601 bp, Human; identical to SEQ ID NO: 959

SEQ ID NO: 8649 - DNA, 601 bp, Human; identical to SEQ ID NO: 960

SEQ ID NO: 8650 - DNA, 601 bp, Human; identical to SEQ ID NO: 961

SEQ ID NO: 8651 - DNA, 601 bp, Human; identical to SEQ ID NO: 962

SEQ ID NO: 8652 - DNA, 601 bp, Human; identical to SEQ ID NO: 963

SEQ ID NO: 8653 - DNA, 601 bp, Human; identical to SEQ ID NO: 964

SEQ ID NO: 8654 - DNA, 601 bp, Human; identical to SEQ ID NO: 965

SEQ ID NO: 8655 - DNA, 601 bp, Human; identical to SEQ ID NO: 966

SEQ ID NO: 8656 - DNA, 601 bp, Human; identical to SEQ ID NO: 967

SEQ ID NO: 8657 - DNA, 601 bp, Human; identical to SEQ ID NO: 968

SEQ ID NO: 8658 - DNA, 601 bp, Human; identical to SEQ ID NO: 969

SEQ ID NO: 8659 - DNA, 601 bp, Human; identical to SEQ ID NO: 970

SEQ ID NO: 8660 - DNA, 601 bp, Human; identical to SEQ ID NO: 971

SEQ ID NO: 8661 - DNA, 601 bp, Human; identical to SEQ ID NO: 972

SEQ ID NO: 8662 - DNA, 601 bp, Human
attctttatatttattgctcagggaaaaggcaggcaatgttagatacaaaagatttagagaatataccttgcatgtgtcctatatgaggaattaaaaaaaaaaaaaggcaactgaatgagaacagggatctcaagaaaaggaatataagaggaaaaaaatggagataggtaaatgtgcgtgtgtttacataaatgtagcaaaatacacattttgttatattttatatatgtatttgtatatgtgtacaaatatatacatctatacaaatatgtatataacatataacaaaaatataaaatmcagattgtcatattacatgaaaggtcaaagttctgttgtatggagtttataagaagcacacctacaacaatatgaaaaaaaagtgaagataaaaaacataacaataacagtcaaatgcatgcaaaatggaaccattaatatacataatatttctataacttttgaagtgagatataacaaaaaatggaaaaattacttaaatctgtattagaagtcatactggtacaatatcaaaactctccccttcttattgcatgattactggaattactgttaattttcaagaaagaataaaaggtt

SEQ ID NO: 8663 - DNA, 601 bp, Human
ttgggaaaactatccacacagtgctttaggtcttatatttgtataagtgcataaatggttgactaaataaaagtagaagagcaatacgataaaagtaggagcaaccgtaatatggtggcctccagttgctgatctcattaactctgacattggtacctctatctcctccctctctagttccatgattcagggctcattcttctcattcatctcttgggaaagagcaaatgctacttagagtggtggttgtagtgagcaatagacagtattttaaaatatctttgtaaatgtctaaaaattkcagatagaaatgtgtcttctaaatcatttaaacactgtgagacatatctaagagatttaaaatgaaaataataggagaaaaaggaacacatgaagctgtagctttgtatattaaaagggttctctaagtccctggcaagattaacaggaaaagtccaatacttagacataccctaagttccaagtgcaaaaaagaattgtaacttttcaagcagggaaaagaaaatgaaaaaatttgctctgaatatgattgttcttatacagcaatggaaattagaagacaattgaataacatctacta

SEQ ID NO: 8664 - DNA, 601 bp, Human
aaaaatgcatatatgaatttcaatctattcatctgcaaaatgatgtttaaatattgactctgataatctcttagaatttttttgaggataaatgaaatacttgggaaaactatccacacagtgctttaggtcttatatttgtataagtgcataaatggttgactaaataaaagtagaagagcaatacgataaaagtaggagcaaccgtaatatggtggcctccagttgctgatctcattaactctgacattggtacctctatctcctccctctctagttccatgattcagggctcattctyctcattcatctcttgggaaagagcaaatgctacttagagtggtggttgtagtgagcaatagacagtattttaaaatatctttgtaaatgtctaaaaatttcagatagaaatgtgtcttctaaatcatttaaacactgtgagacatatctaagagatttaaaatgaaaataataggagaaaaaggaacacatgaagctgtagctttgtatattaaaagggttctctaagtccctggcaagattaacaggaaaagtccaatacttagacataccctaagttccaagtgcaaaaaagaattgt

SEQ ID NO: 8665 - DNA, 601 bp, Human
tgactcatggtaggtatttgataaatgttcgttgaattaaaaatgcatatatgaatttcaatctattcatctgcaaaatgatgtttaaatattgactctgataatctcttagaatttttttgaggataaatgaaatacttgggaaaactatccacacagtgctttaggtcttatatttgtataagtgcataaatggttgactaaataaaagtagaagagcaatacgataaaagtaggagcaaccgtaatatggtggcctccagttgctgatctcattaactctgacattggtacctctatytcctccctctctagttccatgattcagggctcattcttctcattcatctcttgggaaagagcaaatgctacttagagtggtggttgtagtgagcaatagacagtattttaaaatatctttgtaaatgtctaaaaatttcagatagaaatgtgtcttctaaatcatttaaacactgtgagacatatctaagagatttaaaatgaaaataataggagaaaaaggaacacatgaagctgtagctttgtatattaaaagggttctctaagtccctggcaagattaacaggaaaagtccaatact

SEQ ID NO: 8666 - DNA, 601 bp, Human
tcctgctttattttaataatattattgtggtttccattttgtaaagtatatcaagaaaatactgaacctgactgagttatctggtattttgcttggaaacagactgtttgtccaacaaatgtctagtttgatctgtgaatgacgaaacaactaaagctttatgctctactgaaagacttggattgattttcaattttgtggtatcttgttttctctacttgaagactaagagaggcttcagtagtattttcttttttctttttctttttctttttttttttttttttttgtgagatggagkctagctctgtcacccaggctggagtgcagtggtgccatcttggctcattgcaacctttgcctcctgggttcaagtgattctcctgcctcagcctcccgagtagctgggaccacaagcccccgccaccacgtctggcaaatttttgtatttttagtagatacagggtttcaccatgttggtcaggctggcctcaaactcctgacctcaggtgatctgcctacctcagtcctccaaagttctgggattataggcatgagccaccgcgcccagcctcatttccttagactgaaattccttaat

SEQ ID NO: 8667 - DNA, 601 bp, Human
aggtcctgctttattttaataatattattgtggtttccattttgtaaagtatatcaagaaaatactgaacctgactgagttatctggtattttgcttggaaacagactgtttgtccaacaaatgtctagtttgatctgtgaatgacgaaacaactaaagctttatgctctactgaaagacttggattgattttcaattttgtggtatcttgttttctctacttgaagactaagagaggcttcagtagtattttcttttttctttttctttttctttttttttttttttttttgtgagatgragtctagctctgtcacccaggctggagtgcagtggtgccatcttggctcattgcaacctttgcctcctgggttcaagtgattctcctgcctcagcctcccgagtagctgggaccacaagcccccgccaccacgtctggcaaatttttgtatttttagtagatacagggtttcaccatgttggtcaggctggcctcaaactcctgacctcaggtgatctgcctacctcagtcctccaaagttctgggattataggcatgagccaccgcgcccagcctcatttccttagactgaaattcctt

SEQ ID NO: 8668 - DNA, 601 bp, Human
taagtgctttcaaaaagacatcagaaaggtgcagatctttagctttcgttgtgaagtttaagactttcatcactttatggatcctaataaaactagaatcctaaatggaagaaagaagtaaaaagatgattaaaggtaatgaaagtttgaagtacctagcatttaaatgtcattgatttatcattagtttcattcccaccacagaattacaataattctcactctctattgcatgttctcacgtacaaaattataattttcattttgctttccaataccaatgtccaatgtgcaaaacaggtaagattatctcaataatgtaaactgtgtaatgggggcacgtgttctctaagaaagaagaaatcagtgatcaaaaaagtcatctttctctcctgattgccaatcatggctgcatttctactgagtttttatttagaatatttgctaatgtgaataattgaaaaagaattgtgtgcattttgaactggaagttatgcaactgagatggaggttatgcaagtgagattcaagttacagctttgtcattctggaaaaagcgtttcgattctctagacttcagttgtcaaatgataagatgagg

SEQ ID NO: 8669 - DNA, 601 bp, Human
gttccttacggatggactaaatggctggcatcattgctaacaaatgtgtcaacttgatgaaacttatgttgataaataaagtttatattttctatttttatcttttacttccagttccctgtgaactttttgaagtcctctcatgtacatttaatcttctcaagtagtaggaagggaatggcaagccttgtagagaatcttttgtatccaacatggcacccaagcaagtagttccttagtagtctcaaggccctcacatttcactgtgatgtacagaaaacaggcaagggttccctaaagyctgaagaaggtgagaaagtcttgagaaagagtggtagacaaaagatggcctggcctttttgtgaggaagattcaaaggatatggatctagtaaccaaaagccaaggcaggaccatcaacattggcaataggtgccagtgcatgattgtgagaaccagaggaggcaaatgacctatcagatgaggctagccaaggcaaagagaaacatgctaacaaaggtctcattctccctgtgactctaggatactatctggccacccttccccaacacatatgcatatgcatatgcatgtgcatgtgt

SEQ ID NO: 8670 - DNA, 601 bp, Human
agcaaactttccactcaatagctgccaaaactactgtgtccagatcagctgcagacaagagcagagctttcaataaaaattttaaacatgtaggatcagatcctgaagcacttttaaaaaagaaatgtacacaggagatgaaaaatggatttactagtatggtcctgaagacaaagcactatcaaagtaatggctaccaagaggtggaagtgggccagccaaagcaaaaatggcctagtcaagagcaaaggtcttggaaatggttttgtgggatgctcgaggcattttgcttgttgatttkctggagggtcaaagaataataacatattatgagagtgttttgagacagccaaacttttagcagaaaaatgcccaggaaagctttaccagggacaccttctctactgtgacgatgctcctactcattcctctaatcaaacaagggcaattttttagatgagaaattattagatattcaccttacagtctttctttgactccttctgacttcttttgttttctaatcttaaaaatgtctttaaagggcaccctttttttcagttattaatgtgaagaagattgcattgacacagttaaagtc

SEQ ID NO: 8671 - DNA, 601 bp, Human
gaaaaaaaaaaactagtaaaagacagaatgaatatttctacttatacaatcttctcagaagccacatcgtaagatgaacaccaaagctgaccaaaagcatgtcaaaaatttcaagaaacttttgtaatatatgtatttatcaatgaactttttttttttttttttttgagatagaggtctcgctctgccgcccaggctggaatgcattggtgcgatcttagctcactgcagcctctgcctcctgggttcaagtgattctcctgcctcagcctcccaagtagatgggattacaggcatgcgycaccaggcctagctaattttcatatttttagtagagacagggtttcaccacgttggccaggatggtcttggtctcctaatcttgtgatctgcctgccttggcctcccaaagtgctgggattacaggtgtgagccactgcgcccagcctgaactttgtttttaagtgtgtgcagccactactatgaggaagataaaagttctgtttgtttcatatatgctatttaaaaaacaatttccattttttacatttgcatattttaatgcacatttttgaataatacatttctacaattctttagt

SEQ ID NO: 8672 - DNA, 601 bp, Human; identical to SEQ ID NO: 973

SEQ ID NO: 8673 - DNA, 601 bp, Human; identical to SEQ ID NO: 974

SEQ ID NO: 8674 - DNA, 601 bp, Human; identical to SEQ ID NO: 975

SEQ ID NO: 8675 - DNA, 601 bp, Human; identical to SEQ ID NO: 976

SEQ ID NO: 8676 - DNA, 601 bp, Human; identical to SEQ ID NO: 977

SEQ ID NO: 8677 - DNA, 601 bp, Human; identical to SEQ ID NO: 978

SEQ ID NO: 8678 - DNA, 601 bp, Human; identical to SEQ ID NO: 979

SEQ ID NO: 8679 - DNA, 601 bp, Human; identical to SEQ ID NO: 980

SEQ ID NO: 8680 - DNA, 601 bp, Human; identical to SEQ ID NO: 981

SEQ ID NO: 8681 - DNA, 601 bp, Human; identical to SEQ ID NO: 982

SEQ ID NO: 8682 - DNA, 601 bp, Human; identical to SEQ ID NO: 3535

SEQ ID NO: 8683 - DNA, 601 bp, Human; identical to SEQ ID NO: 3536

SEQ ID NO: 8684 - DNA, 601 bp, Human; identical to SEQ ID NO: 3537

SEQ ID NO: 8685 - DNA, 601 bp, Human; identical to SEQ ID NO: 3538

SEQ ID NO: 8686 - DNA, 601 bp, Human; identical to SEQ ID NO: 3539

SEQ ID NO: 8687 - DNA, 601 bp, Human; identical to SEQ ID NO: 3540

SEQ ID NO: 8688 - DNA, 601 bp, Human; identical to SEQ ID NO: 3541

SEQ ID NO: 8689 - DNA, 601 bp, Human; identical to SEQ ID NO: 3542

SEQ ID NO: 8690 - DNA, 601 bp, Human; identical to SEQ ID NO: 3543

SEQ ID NO: 8691 - DNA, 601 bp, Human; identical to SEQ ID NO: 3544

SEQ ID NO: 8692 - DNA, 601 bp, Human; identical to SEQ ID NO: 1994

SEQ ID NO: 8693 - DNA, 601 bp, Human; identical to SEQ ID NO: 1995

SEQ ID NO: 8694 - DNA, 601 bp, Human; identical to SEQ ID NO: 1996

SEQ ID NO: 8695 - DNA, 601 bp, Human; identical to SEQ ID NO: 1997

SEQ ID NO: 8696 - DNA, 601 bp, Human; identical to SEQ ID NO: 1998

SEQ ID NO: 8697 - DNA, 601 bp, Human; identical to SEQ ID NO: 1999

SEQ ID NO: 8698 - DNA, 601 bp, Human; identical to SEQ ID NO: 2000

SEQ ID NO: 8699 - DNA, 601 bp, Human; identical to SEQ ID NO: 2001

SEQ ID NO: 8700 - DNA, 601 bp, Human; identical to SEQ ID NO: 2002

SEQ ID NO: 8701 - DNA, 601 bp, Human; identical to SEQ ID NO: 2003

SEQ ID NO: 8702 - DNA, 601 bp, Human; identical to SEQ ID NO: 2004

SEQ ID NO: 8703 - DNA, 601 bp, Human; identical to SEQ ID NO: 2005

SEQ ID NO: 8704 - DNA, 601 bp, Human; identical to SEQ ID NO: 2006

SEQ ID NO: 8705 - DNA, 601 bp, Human; identical to SEQ ID NO: 2007

SEQ ID NO: 8706 - DNA, 601 bp, Human; identical to SEQ ID NO: 2008

SEQ ID NO: 8707 - DNA, 601 bp, Human; identical to SEQ ID NO: 2009

SEQ ID NO: 8708 - DNA, 601 bp, Human; identical to SEQ ID NO: 2010

SEQ ID NO: 8709 - DNA, 601 bp, Human; identical to SEQ ID NO: 2011

SEQ ID NO: 8710 - DNA, 601 bp, Human
tatgaaatgtccaaaataggtaaagtcacatagataataagaaggctggtggtttccaagggctggtggaatgaggaaatgaagagtgactgctaatagttgagtggtttctttctgaggtgatgaaaatattggttacacaaccttgtgaatgtacaaaaaaccattgaattggatactttaaaatggtaaattatataggatgtgaactataacttaatattgccagtgggaatgtaaattggtacaatcccttaagatgcaattttgcaatatttatcaaaattacaaatgcatctayccttaaacccagaaaattccatttctaggaacttatccttcatatacgttccaatatgtacaaaatgacatatgtgcaaagtattcacttcaccattctttgatatatcaaaaggctggaaacaacctacatgttcatcagtatgcaactggctaaataaactacaatgtatccatttaacaaaatattatgcagccctaaaagctgtgaggataatctttagtcaacaaaatggaatgattgcaaatgttaagtaaaaacaaacaaacaaaataggagctgcagatcagtgtgaagagt

SEQ ID NO: 8711 - DNA, 601 bp, Human
tggagccacggaggtggcgcctggcctctcctcttcctatggcacctgggattcaaacgggcaatgagggaagcactgtagcagggactctgacctttcagtgggtccctgtttcccccttttttccttttcacccaataaaaccctgctttactcacccttcaaaccatctgcgagcctgaattttcatggccgtgggacagacaaggacctcatcgttagctgaactaaggagaagtcctgcaacaatacggcgtttcactcctacatattaacccaaaagaacttaaaaaatatgctsatacaaaaacttgtacatggatgttcacagcagcattattcataatagccaaaaagtgcaaacaacctaatgtccatgaattgatgaatgtatgaacaaaatgtggcatgtccatatcatggaatattattgagccataaaagggaacaatacatgctacaacatagatgaaaggacatctattgtattccatttatatgaaatgtccaaaataggtaaagtcacatagataataagaaggctggtggtttccaagggctggtggaatgaggaaatgaagagtgactgctaatagttgag

SEQ ID NO: 8712 - DNA, 601 bp, Human
attacagacgtgagccaccacgcctggcctgtttgtatttatttcacttccctcttggttactccttctccttacctcacccccttcagattataagcaccaagagattcccagagtacagtggcgtaacttgctgctcagtaaacatttgttgaatgaaagaatgaatgaatatatcacacttaatggtgatcgactgaaagcttcccctctaagattggaaacaagacaagtatgtccactcatgccacttctactcaatattgcactggaggtcctatccagggtaattaggcaagamaatgaaataaaaggtatctagattagaaaggaggaagtaaaacttcttctacttgcagatgacatgatcttgcactaaaaaactctaaagattatacacacacacacaattagggctaacaagttcattaaggttgcaaaatgatcaatgtacatatatcagttgcatttctatgtaacagcaatgaactactgaaaataaaattaagaaaggaagtccatttacaataccactgaaaatagtaaaacaggaataaatttaaccaaagcacaatgcttacacactaaaaattataaaata

SEQ ID NO: 8713 - DNA, 601 bp, Human
tcctctagctcttggcctgcctctggcaccctcattcactcagctaccatctcattcttacaacaagctcgttccagcctcaagagctttgcttctgttgctccttcctccacgttaaactttgctaggatatgtgcatggctgactcccttcattcaggcctctgctcatactacctccttgaagacaccttcctgagtcaagatcacttgacctactttattttcttctccacatgtattgtcatgctatttaaattcaccttacttgtttgtatttctttctttccccacttcccccscgcgagatggagtcttgctctgttgctcaggctggagtgcagtggcgcaatctcggctcactgcaatctccgtctcccgggttcaagcaattctcccgcctcagcctcatgagtagctgggattacaggtgcgcaccatcatacctggctaatttttgtatttttagtagagacagggtttcaccatgttggccaggctggtctcaaactcctgacctcaggtgatccgcctgcctcggcctcccaaagtgctgggattacagacgtgagccaccacgcctggcctgtttgtatttattt

SEQ ID NO: 8714 - DNA, 601 bp, Human
agcctccctcctctagctcttggcctgcctctggcaccctcattcactcagctaccatctcattcttacaacaagctcgttccagcctcaagagctttgcttctgttgctccttcctccacgttaaactttgctaggatatgtgcatggctgactcccttcattcaggcctctgctcatactacctccttgaagacaccttcctgagtcaagatcacttgacctactttattttcttctccacatgtattgtcatgctatttaaattcaccttacttgtttgtatttctttctttccccacttcccccccgcgagatggagtcttgctctgttgctcaggctggagtgcagtggcgcaatctcggctcactgcaatctccgtctcccgggttcaagcaattctcccgcctcagcctcatgagtagctgggattacaggtgcgcaccatcatacctggctaatttttgtatttttagtagagacagggtttcaccatgttggccaggctggtctcaaactcctgacctcaggtgatccgcctgcctcggcctcccaaagtgctgggattacagacgtgagccaccacgcctggcctgtttgt

SEQ ID NO: 8715 - DNA, 601 bp, Human
cagcctccctcctctagctcttggcctgcctctggcaccctcattcactcagctaccatctcattcttacaacaagctcgttccagcctcaagagctttgcttctgttgctccttcctccacgttaaactttgctaggatatgtgcatggctgactcccttcattcaggcctctgctcatactacctccttgaagacaccttcctgagtcaagatcacttgacctactttattttcttctccacatgtattgtcatgctatttaaattcaccttacttgtttgtatttctttctttccccmcttcccccccgcgagatggagtcttgctctgttgctcaggctggagtgcagtggcgcaatctcggctcactgcaatctccgtctcccgggttcaagcaattctcccgcctcagcctcatgagtagctgggattacaggtgcgcaccatcatacctggctaatttttgtatttttagtagagacagggtttcaccatgttggccaggctggtctcaaactcctgacctcaggtgatccgcctgcctcggcctcccaaagtgctgggattacagacgtgagccaccacgcctggcctgtttg

SEQ ID NO: 8716 - DNA, 601 bp, Human
cactttttaatgggtgggcagcattaaacccagggagacccagcctccctcctctagctcttggcctgcctctggcaccctcattcactcagctaccatctcattcttacaacaagctcgttccagcctcaagagctttgcttctgttgctccttcctccacgttaaactttgctaggatatgtgcatggctgactcccttcattcaggcctctgctcatactacctccttgaagacaccttcctgagtcaagatcacttgacctactttattttcttctccacatgtattgtcatgctayttaaattcaccttacttgtttgtatttctttctttccccacttcccccccgcgagatggagtcttgctctgttgctcaggctggagtgcagtggcgcaatctcggctcactgcaatctccgtctcccgggttcaagcaattctcccgcctcagcctcatgagtagctgggattacaggtgcgcaccatcatacctggctaatttttgtatttttagtagagacagggtttcaccatgttggccaggctggtctcaaactcctgacctcaggtgatccgcctgcctcggcctcccaaagtg

SEQ ID NO: 8717 - DNA, 601 bp, Human
cccgggtctcaacctcagtctcctgtgtagctgggactacaggcgcttaccaccacacttggttaattttttaactttttatagagatggaatttcaccgaggctgctctcgaactcctggactccagtgatccacccacctaggcctcccaaattgctgggattacaggcatgagccactgcgcccagccaagcttatttcttttaaagaaaaagagagaatatgtacaattaattctaattggaattacatgcatccaaagaatgccacatggcacttgactgtatttccttaaaataygcccatttagaacactgttagattcgaaatgttctttagtgtataatagcctcaatgtcaccttactataaaaactgacacaaaaaaagttcaagttttaacactttttaatgggtgggcagcattaaacccagggagacccagcctccctcctctagctcttggcctgcctctggcaccctcattcactcagctaccatctcattcttacaacaagctcgttccagcctcaagagctttgcttctgttgctccttcctccacgttaaactttgctaggatatgtgcatggctgactccc

SEQ ID NO: 8718 - DNA, 601 bp, Human
caagcgatatcaagaaaccaataaacaggagctgcctatgggaaggagggtggggagacaggctgaaaagatcctcatctacatgtttatattttttacatcttttatatttgaaggttttgaatgtatttcctggagatgattttaaaaacaggctacttttttttttttttttttttttttttgagacagagtctcactctgtcacctggactggagtgcagtggcaccatcctggctcactgcaaactctgcctccccaggctcaagcaatttcccgccatctacccccctgcccccsggtctcaacctcagtctcctgtgtagctgggactacaggcgcttaccaccacacttggttaattttttaactttttatagagatggaatttcaccgaggctgctctcgaactcctggactccagtgatccacccacctaggcctcccaaattgctgggattacaggcatgagccactgcgcccagccaagcttatttcttttaaagaaaaagagagaatatgtacaattaattctaattggaattacatgcatccaaagaatgccacatggcacttgactgtatttccttaaaatatgcc

SEQ ID NO: 8719 - DNA, 601 bp, Human
tcgattttctcatatgcataacatgcctccaagcgatatcaagaaaccaataaacaggagctgcctatgggaaggagggtggggagacaggctgaaaagatcctcatctacatgtttatattttttacatcttttatatttgaaggttttgaatgtatttcctggagatgattttaaaaacaggctacttttttttttttttttttttttttttgagacagagtctcactctgtcacctggactggagtgcagtggcaccatcctggctcactgcaaactctgcctccccaggctcaagcratttcccgccatctacccccctgcccccgggtctcaacctcagtctcctgtgtagctgggactacaggcgcttaccaccacacttggttaattttttaactttttatagagatggaatttcaccgaggctgctctcgaactcctggactccagtgatccacccacctaggcctcccaaattgctgggattacaggcatgagccactgcgcccagccaagcttatttcttttaaagaaaaagagagaatatgtacaattaattctaattggaattacatgcatccaaagaatgccacatgg

SEQ ID NO: 8720 - DNA, 601 bp, Human
atcatttaattgtccaacactgagtgcttctttagcccagagacagacaaggcaatctaatggagaagtcagacctcagaaccacttatcacaattaaaatatgtattaggaataacaaaggtataatgaatattttgtatagaataaagtcaatttgtaagaatatggaaaattagtaatattaagttttctatttgaactaaatgcagtacacaaattctattagaaaagctggagaatttttaaattaatatttttaatcttgaggttttaaacaagggaaaaataaatataaaatckattttctcatatgcataacatgcctccaagcgatatcaagaaaccaataaacaggagctgcctatgggaaggagggtggggagacaggctgaaaagatcctcatctacatgtttatattttttacatcttttatatttgaaggttttgaatgtatttcctggagatgattttaaaaacaggctacttttttttttttttttttttttttttgagacagagtctcactctgtcacctggactggagtgcagtggcaccatcctggctcactgcaaactctgcctccccaggctcaagcaat

SEQ ID NO: 8721 - DNA, 601 bp, Human
gcaatgtttgcagaatgaggcctccgcactccccttccctcctgggaaaatgtctcttggatttggctaggcttaggaaggacacctggctttagcaaacccatgaaagtcaccccagggctctgctgtgctttagtgaggccatcttgcttgtccctatggagctaatgcatcctttgtttctccccctaaaggagcacagaaataaagacactgttttctcttaggaggcacccatggtctcaaggctacatggtcctctgacagctccctcctcctgtgcctttgccaggggatcctrggagcgcccaccttgagacatgcactttccccaatccctgcaccctgtaaacatttcttccagctctgcactctcctgtgccccacttctgaacctcaaagtccagggagaggcgaccactggcaggagtccactgagaggccagcaggcgaggagcaggcaggacagtgagggcgaggaggacaagaagcaggaaagggagggcatgctcaggcagagcgcctgcaccaccatgccctcttctgcctgcagcatgcatctttcctgctcaccttcttgaagcaaacttgaagcaaaagt

SEQ ID NO: 8722 - DNA, 601 bp, Human
gatccttatttacatattggttgcacgtaacaatttatttggtccagtgtgttattctgtcttctgcacacctaggagttccttgcagtatagtctcatgagcttaaaggagaaaatccaatctcttgctgggggagaggaagatggcagctcccatatcagaatctctttcaactcccctttcagaggtccagacagtcaattgattagttatctatatgggagttcagagcacaatatttcagctacactcaaactctcccaagagcgaagcaaaccactgctgcacagaaggcgataratgctctttctctcctcacctcaacagtgttgagataatatcccgttgaacagaagggaggttctgtccagtcagtctggtctgagcaaaatgaactcatatcctcatgtgcccacatatgtgtgcaatacctcctgctgcagtacttaaaaattcagaaaaatgggccactctacccctccaccttatacaccagagagcctatgggaagcttcatgatcagaacgcaatcacagaacatgctggtggcaaagcaggagttcagaatttctagcctgtgcctcggccagtacacagcag

SEQ ID NO: 8723 - DNA, 601 bp, Human
tctcaaaaaacaacttctcctaagattttacttgaccatcaaaaatcctctccacaaaggcaaaaggtctgcaaatccagtggaggacctggcttgttctaggctctttctgtgacataactgagagatccttatttacatattggttgcacgtaacaatttatttggtccagtgtgttattctgtcttctgcacacctaggagttccttgcagtatagtctcatgagcttaaaggagaaaatccaatctcttgctgggggagaggaagatggcagctcccatatcagaatctctttcaaytcccctttcagaggtccagacagtcaattgattagttatctatatgggagttcagagcacaatatttcagctacactcaaactctcccaagagcgaagcaaaccactgctgcacagaaggcgatagatgctctttctctcctcacctcaacagtgttgagataatatcccgttgaacagaagggaggttctgtccagtcagtctggtctgagcaaaatgaactcatatcctcatgtgcccacatatgtgtgcaatacctcctgctgcagtacttaaaaattcagaaaaatgggccactct

SEQ ID NO: 8724 - DNA, 601 bp, Human
tctgattgctagaaagcactgccaagagatgttgtgtgatttggttttcctaagccgtgggcaccaagccaggtggtcagctgaagccttcctccattactgacaatcatatggagcagggaatgtgttcttttcagttcctgagaatttatttgacagagcatttttatggcattattgggaagcagaagccaaaccctggatgacatccaaaaacatgttttcggtctgttcaaacactatctgaaggaaggaagctgtaatgtgtagagaagcagtaaacaggcaaatgccgaactgrttccaacccagcacttcagcacagaactacagagccacgccatgctgcaaggggcaggaaggcaaccgggcaccaataggaatcaaaagaaaaaaataagggtgccctgataaacacaacagaatataaaacaatttcattctaacacccatctgcaatgtccaaagaagtgtgtgtgaatggagaaggttctacatgtaatatacgaaagtccaaggggttacttccctatctaccatgtgtggctgtctcctcttcattaaaccaaatcttctctcaaaaaacaacttctcctaagat

SEQ ID NO: 8725 - DNA, 601 bp, Human
aaatcccatcctggctttatcacttatgagctttgtaaccccgggcagtaacttcattcagtaactcactaacttcaataactttagtaagttaggaattgcacctgctattgctttactgcatgatctctttccacatcctcctaaaagaaccacatggaatatcttaagtgttaagttaaagtgggtttatcttgaggatgatagttaagttcactatcttgatgtggtgatggtttcacaggtatatacctatcaaagtttatcgaattgtatacttgaagtgtgtacagttcattgyatgtcaatcatatctcaataaaactgtttaaaaataaaagtgagtttaagtttcctactgagattgttatgcctctcctagaaataattagacacctatctacattgggagatgtgtcagataccttctgtttgcccttcaaatccacgctgctttctcagtcctgctctctgccctaggaggctgacctatgaggatcaagtcaaaggacacttgtcttcaggtttctgattgggcttagccaatggggagccctggcaggagtgagagggaaagaggagagtgcatggcctcacctga

SEQ ID NO: 8726 - DNA, 601 bp, Human
ggactggggtctcaaattcaactctgcaccagacaccagccttccccagccctgggagctcttgatttatagaataaacaggctctggggacacaggaggtaagagtgccagttctcaacccaggccacggctggtcccttcatcagctataaggtggagagcaagaaacttgttgctaacaaatgatttttataagtgtttgtgagtattttatttgccttataatttaaagtggaatagcataaggctcagaggattaaatcccatcctggctttatcacttatgagctttgtaacccygggcagtaacttcattcagtaactcactaacttcaataactttagtaagttaggaattgcacctgctattgctttactgcatgatctctttccacatcctcctaaaagaaccacatggaatatcttaagtgttaagttaaagtgggtttatcttgaggatgatagttaagttcactatcttgatgtggtgatggtttcacaggtatatacctatcaaagtttatcgaattgtatacttgaagtgtgtacagttcattgtatgtcaatcatatctcaataaaactgtttaaaaataaaagt

SEQ ID NO: 8727 - DNA, 601 bp, Human
agaaatccggggtaagagcaatccagacctaaggaataaaaacttcaaaggccctgagacctgagcttactagacaagttcaaaaggcccgcccagaacccagtttggccctgtcacagctcttgtgctggtgggtgccactgtagcccctgctgcggcatgacagggtatccctccttgtctacccagtcccacccttccctaaaacttaacacctcctgcctccttgtcctggcttagccagggagatgctcttctttgtagaaagtgggactggggtctcaaattcaactctgcaccrgacaccagccttccccagccctgggagctcttgatttatagaataaacaggctctggggacacaggaggtaagagtgccagttctcaacccaggccacggctggtcccttcatcagctataaggtggagagcaagaaacttgttgctaacaaatgatttttataagtgtttgtgagtattttatttgccttataatttaaagtggaatagcataaggctcagaggattaaatcccatcctggctttatcacttatgagctttgtaaccccgggcagtaacttcattcagtaactcactaa

SEQ ID NO: 8728 - DNA, 601 bp, Human
ggtcctcaataatttttaagcaagtgcaaaaccctaagaccaaaaagtttgagaactgatactctaatgtccaacagtgatcattgccatgaggaaaagtaaagaaggagagggagacagtgacagaggtggcacttgtgatagagtggcaaaagaaagcttctctgggccaggcggggtggcttatccctacaatcccaacactttgggaggctaaggcaggaggctagcttgactccaggaattccagaccagcctgggcaacatgccatgatctcatctctactaaaaataaaaataraaaaaattagcaaggcatggtggcctgtgcctgtagtcccagctaccaaggagactgaggtgggaggatcacttgagcctgggaggtcgaggctgcagtgagctgtgatcataccactgcactgcactccagcctgggcaacagagcaagaccctgtctcaaaaagagaaagaaagaaagaaaccttttctgaagaggagatatttgagcagtgaccagaataaagtgaggcagtgagacttggagaaatccggggtaagagcaatccagacctaaggaataaaaacttcaaaggccctg

SEQ ID NO: 8729 - DNA, 601 bp, Human
aaaatttataatttgttttaacttatggggcaaattttgaatggtaacaacccatttaaatctatgctccctggggtcctcaataatttttaagcaagtgcaaaaccctaagaccaaaaagtttgagaactgatactctaatgtccaacagtgatcattgccatgaggaaaagtaaagaaggagagggagacagtgacagaggtggcacttgtgatagagtggcaaaagaaagcttctctgggccaggcggggtggcttatccctacaatcccaacactttgggaggctaaggcaggaggmtagcttgactccaggaattccagaccagcctgggcaacatgccatgatctcatctctactaaaaataaaaatagaaaaaattagcaaggcatggtggcctgtgcctgtagtcccagctaccaaggagactgaggtgggaggatcacttgagcctgggaggtcgaggctgcagtgagctgtgatcataccactgcactgcactccagcctgggcaacagagcaagaccctgtctcaaaaagagaaagaaagaaagaaaccttttctgaagaggagatatttgagcagtgaccagaataaag

SEQ ID NO: 8730 - DNA, 601 bp, Human
cttaactatttggttttgaaaaatagagcttttttcataagttatttatgttaatatagtgggtttattactatttttcattgaataaaaaaatttataatttgttttaacttatggggcaaattttgaatggtaacaacccatttaaatctatgctccctggggtcctcaataatttttaagcaagtgcaaaaccctaagaccaaaaagtttgagaactgatactctaatgtccaacagtgatcattgccatgaggaaaagtaaagaaggagagggagacagtgacagaggtggcacttrtgatagagtggcaaaagaaagcttctctgggccaggcggggtggcttatccctacaatcccaacactttgggaggctaaggcaggaggctagcttgactccaggaattccagaccagcctgggcaacatgccatgatctcatctctactaaaaataaaaatagaaaaaattagcaaggcatggtggcctgtgcctgtagtcccagctaccaaggagactgaggtgggaggatcacttgagcctgggaggtcgaggctgcagtgagctgtgatcataccactgcactgcactccagcctgg

SEQ ID NO: 8731 - DNA, 601 bp, Human
aagcggccatctgactgctgcttgggagtggctcacacaagtatgcccagggcataaggtccatacagcaactaaactttaagcaatgaccacttcttaacttttggtgtaatattgagtagaatacccacaattatatgaaaaggatattaaaatagccctcccttttccaactacacatctttgtggggccagatttttcttcaacttttactaaaaataatatatcataacaggttaaatgcagaagcagatacaacaacctagcaaacttctattagtagaaaagatgtacaaaaartataaaacaatgccattcttctcacttaactatttggttttgaaaaatagagcttttttcataagttatttatgttaatatagtgggtttattactatttttcattgaataaaaaaatttataatttgttttaacttatggggcaaattttgaatggtaacaacccatttaaatctatgctccctggggtcctcaataatttttaagcaagtgcaaaaccctaagaccaaaaagtttgagaactgatactctaatgtccaacagtgatcattgccatgaggaaaagtaaagaaggagagg

SEQ ID NO: 8732 - DNA, 601 bp, Human
ttgaactcctgacctcaggtgatctgcctgccttggcctcccaatgtgttgggattacaggcttgagccaccgtgcctggctgagttatttaacagtataataaaacgattattgcattttttattctactttatgtaaatcattatctcaaaagagagtgttcaactttttcttataaaaagcggccatctgactgctgcttgggagtggctcacacaagtatgcccagggcataaggtccatacagcaactaaactttaagcaatgaccacttcttaacttttggtgtaatattgagtwgaatacccacaattatatgaaaaggatattaaaatagccctcccttttccaactacacatctttgtggggccagatttttcttcaacttttactaaaaataatatatcataacaggttaaatgcagaagcagatacaacaacctagcaaacttctattagtagaaaagatgtacaaaaaatataaaacaatgccattcttctcacttaactatttggttttgaaaaatagagcttttttcataagttatttatgttaatatagtgggtttattactatttttcattgaataaaaaaattt

SEQ ID NO: 8733 - DNA, 601 bp, Human
attacaggcgcccaccaccatacctaactaatttatttgtatttttagtagagacggggtttcaccatgttggccaggctggtcttgaactcctgacctcaggtgatctgcctgccttggcctcccaatgtgttgggattacaggcttgagccaccgtgcctggctgagttatttaacagtataataaaacgattattgcattttttattctactttatgtaaatcattatctcaaaagagagtgttcaactttttcttataaaaagcggccatctgactgctgcttgggagtggctcacrcaagtatgcccagggcataaggtccatacagcaactaaactttaagcaatgaccacttcttaacttttggtgtaatattgagtagaatacccacaattatatgaaaaggatattaaaatagccctcccttttccaactacacatctttgtggggccagatttttcttcaacttttactaaaaataatatatcataacaggttaaatgcagaagcagatacaacaacctagcaaacttctattagtagaaaagatgtacaaaaaatataaaacaatgccattcttctcacttaactatttg

SEQ ID NO: 8734 - DNA, 601 bp, Human
gttctttcatttgattgcacttgggtgtgttttatgagatggctgcagttagtctaagttgttaaagaaacatgtgcatttccattaccaaagtaggtatcaaatcctcggcgggttggaaggcattctttccggtacattcccaggtgccattttccgaccatatgggtagtataacctgcttcttttaggagctggggcaggagtttttcatccagaggaacacagctgggctgacagggccagattatttggtgctgtaaacctgtacggatcttacagagataaacataaaattatrgattaatgacattgaaatattgtgaacaagcagataaaatggccttctaccttactgatcatatctgttgacttggatgtttaactctattcctgtactggcttgaggatatttctgaaaggcagaattctcttattcaaatgaagtagtggacataaacaggatttgaaagacaaataaaaccattccaacgaacagatattttcaatatttatcaaggcactatgttagaaaccattaacttgttactttttgcctcaaaaaaagtagcaataatatgtggtgtgaatctaacaagaa

SEQ ID NO: 8735 - DNA, 601 bp, Human; identical to SEQ ID NO: 926

SEQ ID NO: 8736 - DNA, 601 bp, Human; identical to SEQ ID NO: 927

SEQ ID NO: 8737 - DNA, 601 bp, Human; identical to SEQ ID NO: 928

SEQ ID NO: 8738 - DNA, 601 bp, Human; identical to SEQ ID NO: 929

SEQ ID NO: 8739 - DNA, 601 bp, Human; identical to SEQ ID NO: 930

SEQ ID NO: 8740 - DNA, 601 bp, Human; identical to SEQ ID NO: 931

SEQ ID NO: 8741 - DNA, 601 bp, Human; identical to SEQ ID NO: 932

SEQ ID NO: 8742 - DNA, 601 bp, Human; identical to SEQ ID NO: 933

SEQ ID NO: 8743 - DNA, 601 bp, Human; identical to SEQ ID NO: 934

SEQ ID NO: 8744 - DNA, 601 bp, Human; identical to SEQ ID NO: 935

SEQ ID NO: 8745 - DNA, 601 bp, Human; identical to SEQ ID NO: 936

SEQ ID NO: 8746 - DNA, 601 bp, Human; identical to SEQ ID NO: 937

SEQ ID NO: 8747 - DNA, 601 bp, Human; identical to SEQ ID NO: 938

SEQ ID NO: 8748 - DNA, 601 bp, Human; identical to SEQ ID NO: 939

SEQ ID NO: 8749 - DNA, 601 bp, Human; identical to SEQ ID NO: 940

SEQ ID NO: 8750 - DNA, 601 bp, Human; identical to SEQ ID NO: 941

SEQ ID NO: 8751 - DNA, 601 bp, Human; identical to SEQ ID NO: 942

SEQ ID NO: 8752 - DNA, 601 bp, Human; identical to SEQ ID NO: 943

SEQ ID NO: 8753 - DNA, 601 bp, Human
tactagaagaaaaataaagaaaacaggagagggaaaaaaaaaactaggaaaaattagaggactgacctggtgaccaaataataggagttctgtacagaaaaaataggggaaggtgggacggagggccacacaattccaaaataaatcatataagaaaattccccataacaaaaggatctgcattttcagattgaaagtgctctctgagtactcagcatgatgaataaatgatgatctacacccaaagcacatcacagtgaaatttcagaaaaccgtctctaatgagagggggaagttgcayatgtaacagattaggaaacagaatggcatcgccataatgaaaatgattttcaaaagtaatctctgagattatgagttttatttctcccttttctaatttgtctataataacatatataacttttactgtcagaaaaaaaatattttttttgagacacagtctcactctgttgcccagactggagtgcagtggcacagtttcggctcactgcaacctctgcctcctggattcaagcagttctcctgtctcagcctcccgagtagctgggactacatgcactcgccaccatgcccggctaat

SEQ ID NO: 8754 - DNA, 601 bp, Human
taatgttggcaatatcagcaaactttaaaaaaagtatatacatacatatatatacacacacacataatacacatttaagagtaatggttaagagcacaggctttggggaaacaagttatgacatctataaattaaaaacagaacttcacaaaaaaggaattatcagaaaacacaaaagagttgctggtaattaacagacatggcagttaaaataaattcaataggaagcttacaaaacagtaagatttcccaaatactagaagaaaaataaagaaaacaggagagggaaaaaaaaaactargaaaaattagaggactgacctggtgaccaaataataggagttctgtacagaaaaaataggggaaggtgggacggagggccacacaattccaaaataaatcatataagaaaattccccataacaaaaggatctgcattttcagattgaaagtgctctctgagtactcagcatgatgaataaatgatgatctacacccaaagcacatcacagtgaaatttcagaaaaccgtctctaatgagagggggaagttgcatatgtaacagattaggaaacagaatggcatcgccataatgaaaatga

SEQ ID NO: 8755 - DNA, 601 bp, Human
aaaggaagagagataatgttggcaatatcagcaaactttaaaaaaagtatatacatacatatatatacacacacacataatacacatttaagagtaatggttaagagcacaggctttggggaaacaagttatgacatctataaattaaaaacagaacttcacaaaaaaggaattatcagaaaacacaaaagagttgctggtaattaacagacatggcagttaaaataaattcaataggaagcttacaaaacagtaagatttcccaaatactagaagaaaaataaagaaaacaggagagggraaaaaaaaactaggaaaaattagaggactgacctggtgaccaaataataggagttctgtacagaaaaaataggggaaggtgggacggagggccacacaattccaaaataaatcatataagaaaattccccataacaaaaggatctgcattttcagattgaaagtgctctctgagtactcagcatgatgaataaatgatgatctacacccaaagcacatcacagtgaaatttcagaaaaccgtctctaatgagagggggaagttgcatatgtaacagattaggaaacagaatggcatcgcc

SEQ ID NO: 8756 - DNA, 601 bp, Human
ttaagggctgaaatatgtctaccttttttttctgaagagtaagttttgggagaaaaacaaattttaacctttttcacagcaggacatacttagaaaattatagtatttggatagcacccacacaagtgaacaaggctgctcagggtagatgctattctggccctgcccaggctcctcagtagatcaatattgcagcacaccatatggaaagctctgctataccatgaggtcctatgagaacactgagatcatcatctgggaggcaggatactgtagtggagccaggctctgcctggctgcrtgacctggggcaagttacttatgccctttgtgcttcagttctcacatctgcaagatgggacaataatagttcccagagaatccattatcatgaggattcactgaactaattcgcatgaaacacttagaactgcgtcccacacatagtaactgctcaacaaatgccacgttcaataactatgcctgattgaaagcaaaacaaaacaactcgtgaaaaaacaaaaccacaaaagtatgagtagaataccaaaatgaattcctcaacatgtcacctcacccctacatggtcatgttacagtaa

SEQ ID NO: 8757 - DNA, 601 bp, Human
ctaggcattcaaaaccagcactgatcaaaatgctatgccaggatattcaaaataaattaaattgagaatgactcccagaatctgagagatcttgttaagggctgaaatatgtctaccttttttttctgaagagtaagttttgggagaaaaacaaattttaacctttttcacagcaggacatacttagaaaattatagtatttggatagcacccacacaagtgaacaaggctgctcagggtagatgctattctggccctgcccaggctcctcagtagatcaatattgcagcacaccatatgkaaagctctgctataccatgaggtcctatgagaacactgagatcatcatctgggaggcaggatactgtagtggagccaggctctgcctggctgcatgacctggggcaagttacttatgccctttgtgcttcagttctcacatctgcaagatgggacaataatagttcccagagaatccattatcatgaggattcactgaactaattcgcatgaaacacttagaactgcgtcccacacatagtaactgctcaacaaatgccacgttcaataactatgcctgattgaaagcaaaacaaaacaa

SEQ ID NO: 8758 - DNA, 601 bp, Human
ttgaactcctgaactcaagtgacctgcctgcctcggcctcccaaagtgctgggatcacaagcgtcagccaccagacccagcctcccatgcattcttgatgggaatgttatcacaagagccacttagagatatttaatacagtcttccagaactagcatcttcacttctgtctgagcacatttaagcccacgtacaatacattaatccatatatactttcactttagaaaatcatttgtcctgaaattgtctaattgtgatctctagaacaaagacttgttttataaacttatgacttccarttcttgcaacaatgaggtcatttcccaggaataattttgctacaccagtgttacatgtcctagcatcttttttttaattgattctttctagtgacttctctaggcattcaaaaccagcactgatcaaaatgctatgccaggatattcaaaataaattaaattgagaatgactcccagaatctgagagatcttgttaagggctgaaatatgtctaccttttttttctgaagagtaagttttgggagaaaaacaaattttaacctttttcacagcaggacatacttagaaaattatagtatt

SEQ ID NO: 8759 - DNA, 601 bp, Human
atgtttcccaggctggtgttgaactcctgaactcaagtgacctgcctgcctcggcctcccaaagtgctgggatcacaagcgtcagccaccagacccagcctcccatgcattcttgatgggaatgttatcacaagagccacttagagatatttaatacagtcttccagaactagcatcttcacttctgtctgagcacatttaagcccacgtacaatacattaatccatatatactttcactttagaaaatcatttgtcctgaaattgtctaattgtgatctctagaacaaagacttgttttmtaaacttatgacttccaattcttgcaacaatgaggtcatttcccaggaataattttgctacaccagtgttacatgtcctagcatcttttttttaattgattctttctagtgacttctctaggcattcaaaaccagcactgatcaaaatgctatgccaggatattcaaaataaattaaattgagaatgactcccagaatctgagagatcttgttaagggctgaaatatgtctaccttttttttctgaagagtaagttttgggagaaaaacaaattttaacctttttcacagcaggacatac

SEQ ID NO: 8760 - DNA, 601 bp, Human
gtgagtacaaccaagacaacaaaacctgacacaaaaaagaaaccactaactctacttccacttctgaattgatgcaaaaatcctaaatgaaaccctagcaaactgaattcatcagtataataaaaatacataggcacggtcaagttggatttaacctaacaaagcaaagatgatccaagattaagatatctattaatatagtatcaaaatataagacaatcctatttaaggtgatcctcattttctcagtgagaagctccaaatgttactactaccagcttgaataaatatagatgtttaygaaatagtcaactatctgtttgaaagtacaattatacatacacatttgcaatcatataataaaggaaatatttatcttaaaatatttttccattctcaaatatcatgaaaaaaattgtattccacctcttcccatgcactcttctttctttctttctttctttcttttgaaacaaggtctcgctctgttacccaggctggagtacagtggcgcaatctcagctcactgcagcctcaacctcctaggctcaagcaatcctccagcctcagcccctccagtagcttggactacaggcacatg

SEQ ID NO: 8761 - DNA, 601 bp, Human
agtagaacaaaagcaataagctaaaataggaacaaggaaagcctcctggagtgaataatcatctcagcatgcagtttcagggctcactatatttcaggcaaaattaatttcaaaacattttaaagacacacacctagatataattcagcaaaaaatgtaaactatggaaataattttttaaatgcctccacaaaaggcttcagggaccagctaaacagaaagatctttccaacattctataaactattccagagcatagaaaaagatggcaaaactaaccacattattttatgaagtgagyacaaccaagacaacaaaacctgacacaaaaaagaaaccactaactctacttccacttctgaattgatgcaaaaatcctaaatgaaaccctagcaaactgaattcatcagtataataaaaatacataggcacggtcaagttggatttaacctaacaaagcaaagatgatccaagattaagatatctattaatatagtatcaaaatataagacaatcctatttaaggtgatcctcattttctcagtgagaagctccaaatgttactactaccagcttgaataaatatagatgtttatgaaat

SEQ ID NO: 8762 - DNA, 601 bp, Human
acaggctgggcgtggtggctcatgactgtaatccgagcactctgagaggctgaggtgggtggattgcctgagctcaggagttcgagaccagtctggccaacatggcgaaaccttgtctctcctaaaaatacaaaaattagccaggcatggtggtacacgcctgtaatcccagctatttgggaggctgaggcaggagaatcacttgaacccgggaggcagtgattgcagcaagccaagatcatgctactgtactccagcctgagtgacagagcgagactccatctcaaaaaaaacaaaacaracaaaaaaaagagttaatataaatacacaatggctgcattaagatgttgaggtcaatcactgttttcagggttgcagaatcggttttcctagtcttaactcatgacctagttactcaagagttgtccctaaccttaactcattttactccaggtcagattcctgtgcaggttcctggaatttagcaactacaaagatcagccatggtgacaagcatccagaatacaatggtgtcttcctaacagccactagtgctgcttctctggaccactaccctgcgaaaacaacaaacacagaacaa

SEQ ID NO: 8763 - DNA, 601 bp, Human
actatagagttatagtaaccaaaacagcacggtactagcataaaaacagacacctagacaaaaggaagagaatagagaacccaaaaataaatccatacatctacagtgaacccattttcaacaaaagtaccaagaacagacactggagaaaggatagtctcttcaataaatggtgctgggaaaactggatatccatatgcagaagaatgaaactagacccctatctctcaccatatagaaaaatcaaatcaaaatggattaaagacttaagtctaagaacacaaactatgcaactactaawagaaaacattggggaaactctccaggacattggactaggcaaagacttcttgtgtaatatcccacaagcacaggtaaccaaagcaaaaatggacaaataggattccattgagttaaaaagctcctgcacagtaaagaaaatgaccaacaaagtgaagagataagccatggaatgggagaaaatatctgcaaactatccatttgacaagggacaaataaccagactatataaggaactcaaacaactctatggggaaaaaaaatctaataatctgattaaaaatgggcaaaagatctgaat

SEQ ID NO: 8764 - DNA, 601 bp, Human
ttctttgagtaggaaagggaattccctgaccccttgcgcttcccgggtgaggcgatgcctcgccctgctttgcctcaggctcagtgcaccacacccattgtcctgcacccactgtccgacaatccccagtgagatgaacccagtacctcagttggaaatgcagaaatcattcgtcttctgcgtcgcacatgttggaagctgtagactggagctgttcctattcggccatcttggctccacccctcctatgtatttcttaaatctgtcctcttatctccatccaccttccctctgcctttaytcaagtgctccttatcttctctcctctctttattgtcagagcctcctaaaaggtcggcctgcttccaatcaccctccatttcagttctaaagtgaaaatctgatcctgcttaaaacttttaagtgcctcactgtcaccatgagacccttcacaattcctccctgcatgtgcacaggccccttctgagtggacccctgggtcatgctctctagcctcacatctcgctgctctccaccttgcagtccaggctccagcaatgcagacccccctccaggactgctctcccaacctccctgtctt

SEQ ID NO: 8765 - DNA, 601 bp, Human
ttcaccctcaagtcactgtgacaaccaaaccacttctgctctccgtctcatgtgtactatgaatctatgcactctgatgcactactgctatgtggattatgtgggtactctggccatgggcttcactctttccagctctttgcagatgtatccatgccatggggagaacatgaaaggctttcattagcactgacaacatcctgaaaactggcagaattacaaaaccatcagctttcctagtaaaaagagctctcaacatcaagtggtccaagctctcctatgtatttctttttttttttttaatactttaagttctagggtacatgtgcataacgtgcaggtttgttacatatgtatacatgtgccatgttggtgtgctgcacccattaactcatcatttagcattaggtatatctcctaatgctatccctcaccccttcccccgaccccacaacaggccccggtgtgtgatgtttcccttcctgtgtccatgttttctcattgttcaattcccacctatgagtgagaacatgtggtgtttggttttttctctttgcgatagattgctgaaaatgatggtttccagcttcatccgtgtccc

SEQ ID NO: 8766 - DNA, 601 bp, Human
caaagggcaacacatccctgagaacagccagagacaaagaggggaggtgggactaccatccccagccctggaacctctgctttgtaactcagccagggacaccaaatcagcatggctgttcagtaaaatgtattggttattattttcactcaataaaataatcaacaaattagtacctattactaataaaattttaaagtgatccaacatgctctcagtgtggacattaacaggtgaaatctaaagaggtggcatgaattaatgactggctatggaaaagttcattcaagtctcattattytgaggcatgggttgtaattttcctctatgatagacgcgccaaataaatgcataattgcaaagagtaatagaatgtggacacactcactgatttattcacataacagcttttccttagctttgtcagaaattcatttaagtgtctgaagaacccagtgagattggtttcctagcacatataactttgttcctggcacagaatttctataatattttataagtctgccaattgcataagtatatttaaaaccttgaatgagctctctctttgccaactaccagttttgaaggaaattcttat

SEQ ID NO: 8767 - DNA, 601 bp, Human
atagcatagtatatattaagtactataataaaacattgaagatctgataaacatagagattgagaggcattttttccttcgactctgggattatgaattcaatggtttgacacagagaatacaaatgcaagaccctttggtgcggggtgggggtggttttaaaatgtattggttattgatttcggaacttctagttccaaaatgataacacagacacaatctaggttcactcctctccacagaaaaccaaaacaaatataaggtgccaagattatcaccagcaacatcgcagaactcaaayatgaggatgattccatttccagggtcacagagaagtgaaaaactctgaggagatggtaaaagaatcaaatgtccatatctgctacaccccccacccactgtggcccaactcatggtttctacactggaaaaagtgagatggaggtaaacaaccagcttccccaccatcctgggttccctggcaggaggcctgcccatgctttaacccatgggaagcaacacgagtacccaaagggcaacacatccctgagaacagccagagacaaagaggggaggtgggactaccatccccagccctgga

SEQ ID NO: 8768 - DNA, 601 bp, Human
tatatatcatatatatgtaagatatatatatgtaagatatatatatcatatatatgatatatatatcttatatatataatgaatatatatattcattaattataaactcatagaaaggccacagtgctctcttctcacagaattgtgaaaatcatgactacttcatgtttctcctgctaaaagttcataatatcaacaataagacattatagcatagtatatattaagtactataataaaacattgaagatctgataaacatagagattgagaggcattttttccttcgactctgggattrtgaattcaatggtttgacacagagaatacaaatgcaagaccctttggtgcggggtgggggtggttttaaaatgtattggttattgatttcggaacttctagttccaaaatgataacacagacacaatctaggttcactcctctccacagaaaaccaaaacaaatataaggtgccaagattatcaccagcaacatcgcagaactcaaacatgaggatgattccatttccagggtcacagagaagtgaaaaactctgaggagatggtaaaagaatcaaatgtccatatctgctacacccccc

SEQ ID NO: 8769 - DNA, 601 bp, Human
agctcactgcaacctccgcctcccgggttcaagcgattctcctgcctcaacctcccaagtagctggaattgcaggcacaaggcatcatgctgggttatttttgtatttttagtagacataaggttttgccatgttggccaggctggtctcgaactcctgacctcaagtgatctgcctgcctctgcctcccaaagtgctgggattacaggtgcgagccactgtgcctggccagggtctttatttctttctaagatcagatgatcttgtaagatccttacaactcctaagaaaaaaaaaaaaagaggggtggggaagggataggtgtaatacaaaatgtcaagttgcccttaacccttaacttgaatcaaaataaatgaacctctgctcacataggaagctgtctttctcacttacctcaagagatttctcaaagcctgcaggtctcactggtgcctgctaattccctcatgattttattttgcatctctagtcagcagagtcttgaagtttgataagccctgcataggtctttatgcttagacagggctcacctagctacttgtccaaataggagtcctaacagtaatgcattcaataatgt

SEQ ID NO: 8770 - DNA, 601 bp, Human
ctgtgaagtcttctcacacaactccactcatatttcccctccctactacgaaacagcacttactgtcattgtcaatgtcacaccatttagaaattagttgtataaagtcttacactattagcaagtgggttggatagctagccttactgctcatataagaatgtaaactcttgaaagcagaacctggaacttttatatgtgcgtaaacacagaggtgacactgctcatcacacagaagatgctcaataaatgaaggtgagttgaggtttttattttaccgaaaaagtattaatgcaagttyccaaggtgtcaaatatatacccatggattgaagaatgggcctgaatttttataatcgtttacagcttcctacgtatttttctggatttacaacaaaatccctaagtagaagaaatcagtccatggatccccaagaaaactagagccagctcccgctcaagtttcaaaggctctgaggtgtgatgctgttaaaagcatctatttgcccaaagttgttcttatcttcacagtcactcacaagtcacaatattttaaacaattattcccaggcccacaacaattacttttttttgtggaggtc

SEQ ID NO: 8771 - DNA, 601 bp, Human
tccattattttctccatggaggcatctggaatggaccattctctctctctctgcctattcaaactctagcatccttccgccaacagctcaagccccagctcctctgtgaagtcttctcacacaactccactcatatttcccctccctactacgaaacagcacttactgtcattgtcaatgtcacaccatttagaaattagttgtataaagtcttacactattagcaagtgggttggatagctagccttactgctcatataagaatgtaaactcttgaaagcagaacctggaacttttataygtgcgtaaacacagaggtgacactgctcatcacacagaagatgctcaataaatgaaggtgagttgaggtttttattttaccgaaaaagtattaatgcaagttcccaaggtgtcaaatatatacccatggattgaagaatgggcctgaatttttataatcgtttacagcttcctacgtatttttctggatttacaacaaaatccctaagtagaagaaatcagtccatggatccccaagaaaactagagccagctcccgctcaagtttcaaaggctctgaggtgtgatgctgttaaaagcat

SEQ ID NO: 8772 - DNA, 601 bp, Human
ggactaatacactgattttcacccaattccaaaagatggctgcatatgtatcaaaaaggcatacttcagccaaaaagtcacgagcagtctaatagctctttgttttagttggaattcagtgaactacattctcccatggtggaatccattcccaggggtattatgtcagataccgctttacctcccatgtgactgaggcagcctatagctgccttctgacagtcatcaaggcaacgctaacctttctgcatcattatcagatggactcacctaactgtggtaagaggacaagtgtaagagrcaaggctaagtctccattctaacataagtggttgcacttagcctctctgggtctctgtttttaaaatgaaaacattgtgtggggattgtctctaaaaccctttccagctctatctttctagaacttcaattatccaggatttctctgcatggctcccatactctaagctgacctggatcacagcctactgacacagtgattataagcttgagctctgaaatcagacaggcctgagtttgactccattcctccacttaggaagtgctatgctttgaatgagttatattactctctaagcac

SEQ ID NO: 8773 - DNA, 601 bp, Human
ttttctcattaagaaaacatgaaaaaagagtcctacaaggttaaggattgttctgtaagaaaggaacaagcctggaaggcagaatttctgtatacaacattttgttgatgctttgtacctaactgccaaagacagcaagagaagcgactggggatttttttcaaatatatttttattattgtttttaagcctgatggggcaatctcatgcttctgaaagcaatggacagcagcctgtttgaagccaagcacagcggggtggtcccccaccaagagcttaggcactgcgttcccaggccctscacggaagagcaagtctctgataaactcctggggaggaaggcgactgtagtctttcctcagctgactaagccagagcttcaaatcaagtcagagaaccacagtaatctttgtataaccccaaagcggagaggaatctgggacagaatgccaacaaaggctagcccgggaaatctctctctcgttttctggagcgaatgccttgatacaaatatattgcacacatatgtgcagcagttaccactgccctcaaggagaaccccacacaaggagagtaaaatgggaaagtattagtctgtttt

SEQ ID NO: 8774 - DNA, 601 bp, Human
ccaaagtgggagtttaaaatggcaacctacggccagcactgtcagcgcaaacacagcactccctttgttccccacctctatttcttttatattttgactaatttgcatgtatctgaatagttcaccagatcacaggctattttgaggacaggtatataacttttttggtagcttccacggcaatggatgtcattcttaatgtttgctaaatttgttacaacaatcctcattttttaaaaagaagatattgacaagaaagtgttctgagatggaaacaaaagaaaaagaaaaagaaaaaaaagatccttttctttgaatagtcacggtaggagaggctgattagatatggcccatactgtgaaagaaaaatacaaaaaaagatcataaagattacagtcagttaagagtgtaaaccactggaaaggaataaacctgtggtgccaataatctctgaaatattttctcattaagaaaacatgaaaaaagagtcctacaaggttaaggattgttctgtaagaaaggaacaagcctggaaggcagaatttctgtatacaacattttgttgatgctttgtacctaactgccaaagacagcaagagaa

SEQ ID NO: 8775 - DNA, 601 bp, Human
gcttgttaactgactaatttctgttaccaaaaagaaaataatgagtggtcaggtgacctcacctgggaccagcctgatgatcacaacccaccatagacaccaaccggtcaggccactccctccagcgactcacagatgtgatctgaatgcactgtacacagggttatttgcagccctgagttttccttaggccccactactcagcctgctctattacctctggactccagagggaccttcaaacaaaaggggacaccaaagtgggagtttaaaatggcaacctacggccagcactgtcagygcaaacacagcactccctttgttccccacctctatttcttttatattttgactaatttgcatgtatctgaatagttcaccagatcacaggctattttgaggacaggtatataacttttttggtagcttccacggcaatggatgtcattcttaatgtttgctaaatttgttacaacaatcctcattttttaaaaagaagatattgacaagaaagtgttctgagatggaaacaaaagaaaaagaaaaagaaaaaaaagatccttttctttgaatagtcacggtaggagaggctgattagata

SEQ ID NO: 8776 - DNA, 601 bp, Human
cttccccactgcccacagggagctaagggaaaccatagctcgtgcctcatgatgtaagtaaggatctgtgggcaactgtgattgccatttacttttgcttttttttttttttttttttttttttttgagacagagtcttgctctgtcacacaggctggagtgcagtggtgccatctcagctcactgcaatctccgcctcccaggttcaagcgattctcctgcctcagcctctgagtagctgggactacaggggcataccaccacatctggctaattttttatatttttagtagagatgggktttcgccatgttggccaggctggtctcgaactgctgacttcaggtgatccgcccacctcggcctcccaaagtgctgggattacaggcgtgagccgccatgcccggctgcttttgctatttttgtgaatgaaggaataaagttgatctcctttaaagaatttaaaattcttccatcgaagaatcaaaagaaaacaatggaaacctgagattttgaactttaacaaaaatccatgaaattaattgtattctcttccataatttgcctgttttaatataacaatgttttaaattattaaccag

SEQ ID NO: 8777 - DNA, 601 bp, Human
gagtgcagactccatggcccagactgtgcgcagacagacttcatatctgtcacatgggatggaggcacatccttcggggagtcacattaaccatcatcaagatttgccagtgtcaagaagcacaggatgagtatgatgggtccaaagggcctgggacctgaagagggctgtctaacagccaagcaaaccccatggccacatgctagactgcttccccactgcccacagggagctaagggaaaccatagctcgtgcctcatgatgtaagtaaggatctgtgggcaactgtgattgccatttrcttttgcttttttttttttttttttttttttttttgagacagagtcttgctctgtcacacaggctggagtgcagtggtgccatctcagctcactgcaatctccgcctcccaggttcaagcgattctcctgcctcagcctctgagtagctgggactacaggggcataccaccacatctggctaattttttatatttttagtagagatgggttttcgccatgttggccaggctggtctcgaactgctgacttcaggtgatccgcccacctcggcctcccaaagtgctgggattacaggcgtg

SEQ ID NO: 8778 - DNA, 601 bp, Human
cttctagtggccagatcatgaaaagataaaaataaactgttgaaattaattatttttgagacagggttttgctctgttgcccaggctggagtgcaatggcatgatcaccactcactgcagccttgacctccctggctcagtcaatcctcccacctcagcctcccgagtagctaggaccacaggcatgtgccatcacacccagctaatttttgtatctttttgtacagatggggtttcaccctgtttccaaggctggtctctaattcctgggctcaagtgatcaagttctgggattgcaggygtgagccaccacgcctgcctggctgaaattaattttaataatatattttattcaacccaatatataaaaatattatcatttcaatatgtaattcatataaaaattatggaggtattatttttcattattttttcatatcatctttgaaattcagtattttacccttacagcacatctcaattcaactttaccacatttcaaatgctcaatagccatgtatgactagtggctacctgttgaacagcacagacccaggcccttttctcccctgaataatgaaggccagggcactatttagta

SEQ ID NO: 8779 - DNA, 601 bp, Human
tcctaagcaaaatgactttactactcctgcctccaaagtacattaaacagacacagcttttgccttgaagactcttacagtctactatgtgttattctcacccagcctgatcattgcaagagaaaatcttcaacaaaataatccctggagaactctcaagaggtatgaattactgcaattatgaagctaccatctaaagcagcactgtctaatggaaataaaatgtgagccacaaatgtaatttaaaatcttctagtggccagatcatgaaaagataaaaataaactgttgaaattaattwtttttgagacagggttttgctctgttgcccaggctggagtgcaatggcatgatcaccactcactgcagccttgacctccctggctcagtcaatcctcccacctcagcctcccgagtagctaggaccacaggcatgtgccatcacacccagctaatttttgtatctttttgtacagatggggtttcaccctgtttccaaggctggtctctaattcctgggctcaagtgatcaagttctgggattgcaggtgtgagccaccacgcctgcctggctgaaattaattttaataatatattttat

SEQ ID NO: 8780 - DNA, 601 bp, Human
gtcactgggaggcaatacccttatttcaaagatgatgctcaaaactggttttggaattgccttcgaagccagtttatgagtttcctaagcaaaatgactttactactcctgcctccaaagtacattaaacagacacagcttttgccttgaagactcttacagtctactatgtgttattctcacccagcctgatcattgcaagagaaaatcttcaacaaaataatccctggagaactctcaagaggtatgaattactgcaattatgaagctaccatctaaagcagcactgtctaatggaaayaaaatgtgagccacaaatgtaatttaaaatcttctagtggccagatcatgaaaagataaaaataaactgttgaaattaattatttttgagacagggttttgctctgttgcccaggctggagtgcaatggcatgatcaccactcactgcagccttgacctccctggctcagtcaatcctcccacctcagcctcccgagtagctaggaccacaggcatgtgccatcacacccagctaatttttgtatctttttgtacagatggggtttcaccctgtttccaaggctggtctctaattcctgg

SEQ ID NO: 8781 - DNA, 601 bp, Human
gtgataattatttctaacctaccccagagaagtagaagataaagcatgctccagaacaaaaagtatttttaaaagaccttaataataacaaccctcttttttggaaaaaaagattgtttctattttatggggaaatactttactaatcgtgagtttgtccatagaaagattttataatattaaaaaagaaagattcctgaatatggatggattagccttgagaatatatttgaactatatagtttctaatgattaaaatttcaaagaaaatatgttttacaatatggatcctgaataacayattcaggatcccacaatcctatttgttgtatgttataataacttttcttccggccataatcctattttttatatgttgtaataatttctcttctggcaccaaggaagaaaggatagcacatcacagcaaacaagttaagcatctgggttttctttgaagcagctggaaaggctttctttccccattctgcctccattatgttgcattctgcattgatgaaataacaataggtatgatcgtggttcctgtccaagtgcctttctacatgctgagtccccactggaggtatggactataaga

SEQ ID NO: 8782 - DNA, 601 bp, Human
tcttttccaaaatgtgtctcttactctctacacactgtatatatacatgacagggagaaagatccaccgaccattattttcacacctgcaaacatattctcaaagttccatatgtttttcaaggcctcaatgcttaagaaaatacaccttggctgactggttgcatatctccaaggaagaggctgtttatgtctgctcctgtctgaatcttgagacttggaacaccttattatcatgacccataatttcttcctcatttacagttctcagcaggatctccagttgatggctacacagaccrtgccctaatccataggaacacagtttctgcattcaatgtaaaaagtgatcttgcttaagtcccaaaatcaattagtgcttcaagacttgggaaaatattatcaacaaaggaatagccacccaaggaaaaaagcaaataaatccctgcagagaaaataaatgccattcatttccagtcatatacagcaataaaactgattaaattcctcacaaatataagctgacaaagcagtgggaatgtgataatgaaggtctcatagcttcacagggactttgcctccgagaagctagcaaggatgcc

SEQ ID NO: 8783 - DNA, 601 bp, Human
ggctcagggcaaggcactgtgattgcccctgtgagaaactcacgaaagcctgctctgacctggtcaccatagcagcagctggaacaaaatatggtgcttcaagcatctgcagtgatgcatagacgcgtctacaagagacactgtcttagtaagtgtggtttctaaatgacagcctggagctgaaggatgcaattgtggcttttgctttaactatggatcacagtcccttaagctcacgtcgtcatctgaaaaacagagaataacatacctacctcacattctggaaaagacttaaaactaraatgctgccattcaatagttttaagaatttcagtaagatttaaagacagcaattggctattgagtcattagctcctgcttgccccaatcctacccagttgcaaattctgaggacttcagtgaataggttcagctctgctcaggccctagagactgacagcttcatgttgagtctacagttttctctgctaccctacagtattatgtgtgggcatctgcctgctttccaaatgtacattccagtttcctgaaagcgaggttccaaggcctgcccagcccttatgaacctccttttccaggg

SEQ ID NO: 8784 - DNA, 601 bp, Human
aataaaataggctggatgcggtggctcacacctgtaatcccagcactttgggaggccaaggtgggaggatcgcttgaacccaggagtttgagaccagcctgagcaacatagcaagactgtctctaataaaaaataaaataaattattatttaaaagtgaactctggatgaagtcatttatctggaataagactactgtgcagtcatctgagcaacacttcaaacaggagacaggatggaagtcaggggtagaaagatacactgtgagacttaggtcttagtggtcctctaccctgctagcyacaggccatacctgcggcgggttatcagaaccctcagaaggcaataaggctgggacagcagtgggggacacacctccaccacaggggatggggtgagcatccctcggcacctggactcttgtccccatgagctctgcacatctggtgatctgactcctaaaaccattcctctgtgcttcagctcctcatagatcaccatcagaagtccttacagccagaacctctggctcacattgagatctggctctccccagaggacaactgcttcctctgcagccttgttgcttgttactgcacttc

SEQ ID NO: 8785 - DNA, 601 bp, Human
cacacatgcatgcacaaatacacatctaaagaactttcaacccaacatggtatttctgaaacttagaaactttcaagacctcttcttaatgcctgattttctaaaatgttagaataacagtgatttattaaattaagtaactcttcttcagacatttttagagtcaaagcaatttttatcaaaaggtcactaccaaataattagctaattagcaagaacatttttttctcagttcaaaaagtaattagaaattataaccatgaaggggtgctaattgggttttcacagaagcattaagtgmctgaacatttttttcatttgtttcacccctctgccgatgaaagttaccgtgattaatcctttctcttctgcatgacaacagcaacataaaatgctgcagttgagtactggtaatagaggataaggaacagagtcaattaagatttgggattttccataagtgtgagatttcctattgattggctacaatttcaatacaggaagctaggaaccccactctccaatctgagagaagaaggtggagttgcagagagaatggagctcaatattccctcgtgggctcacctgctgtgactttata

SEQ ID NO: 8786 - DNA, 601 bp, Human
gtctcgaattcctaacctcaagtgatccacccacctcggcctcccaaagtgctgggattacaggagtgagccactgtgcccagcctgcagttatgtttaaaggtggaatattaaaccacaggttcaagggggaatcaaggaagactagatatacttcaatcaaatttggccaccatcagttaatttcttagaaacttataagagaacagaccaagagacagacacaactcaaacagtcaccacacttccttacgctggctcatcagcatcatgagacaggctttcaaccctaaagacaatkcattctagtttttaactataaatttgactgaggtgtagaaaatagatgtattagtaaataggcttattgtttctcttaggaattgtattgtcttctaaatacagcaactaaatatttgacatgtaattttatagttaatatatctgcacattagggatttctgatggcactattacatacatattaaaaccactactcttaatgcttctgttagctgaagtcagaagctttaggaaggcaacacattgtgaggtttttttattaagttattttctacgtggaattaaactttatagaaac

SEQ ID NO: 8787 - DNA, 601 bp, Human
tcttattgataaaaacagaaagataagaaggaagctacaacatcaatttgttctgcagattaaatgttacattaatgccaagttttctccttgagatttatcattttcttattaagttgtatcatttatcatgtcctaaaagcaatacaagtgtgtaagaaaatcaggaatggagcaaagaatgagacaaaggtttagtaagtggaggttgttattcattcttggggggatctttttggcctgtttctaccagtaattataaacacatagatacacacacacatgtatttcaatgtcaaamtttaaattaccaacttgctatgtgccaagcacagggaatgatatagtggtgaacaagacagacaaggcccctgctcctataaagctgaattctggtgaaggagacaggtgataaataaggaaagcaaataataaacgttgagagaattcccactgtggtgagtgccaggacagaaaccaaacactgtgatggggcagaccatgagggaaaagggagagggtgcagaagatagaggagttgacttctgagctgagaattaaaatgaccaggagtcaaccctgtcaggtcaggatgaagaga

SEQ ID NO: 8788 - DNA, 601 bp, Human
cacacagacaaactgtctttagtttaaagaggagaacagactttatcagatttcagggttaatgtggtaaaacactaaacttgcctgtcttccgggaaaatgcacgtagaacaagaggtcactgagatgaggacccctgggaatcctacctcaagaccctctgtttccttcccatccccaaagacatctttctcttattgataaaaacagaaagataagaaggaagctacaacatcaatttgttctgcagattaaatgttacattaatgccaagttttctccttgagatttatcattttcytattaagttgtatcatttatcatgtcctaaaagcaatacaagtgtgtaagaaaatcaggaatggagcaaagaatgagacaaaggtttagtaagtggaggttgttattcattcttggggggatctttttggcctgtttctaccagtaattataaacacatagatacacacacacatgtatttcaatgtcaaactttaaattaccaacttgctatgtgccaagcacagggaatgatatagtggtgaacaagacagacaaggcccctgctcctataaagctgaattctggtgaaggagacagg

SEQ ID NO: 8789 - DNA, 601 bp, Human
tcagaatggagcagcccaacaaatactcagagccatcagatgatgccaaggatacctcattattcgttttatttcatgaaagtctttgtttttgagacagagtctcgctctgtcactcaggctggcgtgcatgatctcagctcactacaatctccgccaggttcaagcgattctcctgcctcagcctcccgagtagctgggactacaggtacctgccaccacgcccagctaatttttctgttttcagtagaggcagggtttggtcatgttggccaggctgttctttaactctggctcaagygacctgccttggcctcccaaagtgctgggatttataggtggtagccaccacacctggcctcatgaaagtcttcttatggacattaaacgttcctattatttttctagtaatttgccaggcaatgggctactttctttagtttttgagcttgctccttgttccttatgtgtgtatttttgcctagaagagacataattcaattctggcagaaactttcccttttgtcaaacaaatctggttttcactatcaatgcgcaatcagcttggtttctgcttcccagtcatttcctggataccttt

SEQ ID NO: 8790 - DNA, 601 bp, Human
aactcctgggctcaagtcatcttctcacctcagccttctgagtagctgggattacagatatgtgccaccacacccagctaatatttaaaacttttttttcgagacagggtctcactatgttgctcaggctggtctcaaattcctggcctcaagtaatcttcctgccttggcctcccaaagtgctgggattacaagcatgaaccactgtgcccagcagccacatattaatattttttatcagaaacattatcaaatttttaattaaaattaatgaacaaataataaggatttctttcaaaarctgactttaaatctaaaatcatgtggtttattatacaataaagtctaatctggtaatccaaaagttagaaagtattattttaaatattaatttacaaagaagaaagaaatgaactaggaagtactaccttgttttacagagaaaagtaacatttcagagtctattatttaacaatataaaagaaaacaagcccttaatgtgaccaccaatccttctcaatgccacaccttgttggacagaatggcccacgtatcagaatggagcagcccaacaaatactcagagccatcagatgatgcca

SEQ ID NO: 8791 - DNA, 601 bp, Human
catgatgtcacatggcccatgagaaagcatgttttgagctcataatatgaaatagaggtcagacaggagcttctcccccatgtgaccaacgcatctacattttacaggaatttcttcctcttgggatcaattcacaatacctctatccatttccatgtcttgataaaaaccaaatagaaaatcagaaattatttttaaagcagctttgctgaaagaatattcaaggcattagaaagaaagaatcaatatatcattttgatcacttaaaagctttttttcatggttactcaaaacccacgcmgagctaggagatagggctcattaaatcagagggattctggaagaccatttcctggtcagctggagcaatgttgcctgcaccagtcctatccctaacagccaaaaactgtgatgagaaccaggcttttaaaatgtagttttaattcgcttttttttttttttttcttttgttgagacagagtctcgctgtcgcccaggctggagtgcagtggcgcgatctccgctcactgcaggctccgcctcccaggttcacgccattctcctgcctcagcctcccaagtagctgggactacaggcgccc

SEQ ID NO: 8792 - DNA, 601 bp, Human
ctggtccagaaaggggcctgagaatttgcctttctaacaagtttccaggtgatagtgatattgctgctcctgggaccatacttagagaactattgctccagaaagagatttaatggctaatacaataaagtcaagtgatcttactctgtatttttgttgttgttgttcttttaaatcaacaaaagtgattcaagtgtcaagtgtggttgaatggtgagaatgaaaaaataagcaaaaaacgaaggggtattgaatcagtgcagaatagtcagaagtcacacacagagaaaatggatgtatyttacctttggtgaggagtaaattataaaaggactgtagctactttctgaaaggtaaaattgtcctgactcaaggatgaaaaggtatgtcaaaggggaatgttttataataatgagtccctgggtctagacctgataccagtggttctcatcctggctacattatagaattacttgggcacactttgggaggccaacgcagatggatcatctgaggtcaggagtttgagaccagcctggccaacatggtgaaaccccgtctctactaaaaatacaaaaattagccgggtgtggtggtgcac

SEQ ID NO: 8793 - DNA, 601 bp, Human
ctatttctagaccaagtaagttcagacaacgattacttcaaaaatatctgagcacactaaaaaaatttttaaaaatccaactatctgaaaatataaaatctctctagaacagctctcaagcaatagtgtgtcgaatcacctagaagtcttgtgaaaacagactgctgggaaccatctccagagcttctggtccagaaaggggcctgagaatttgcctttctaacaagtttccaggtgatagtgatattgctgctcctgggaccatacttagagaactattgctccagaaagagatttaatrgctaatacaataaagtcaagtgatcttactctgtatttttgttgttgttgttcttttaaatcaacaaaagtgattcaagtgtcaagtgtggttgaatggtgagaatgaaaaaataagcaaaaaacgaaggggtattgaatcagtgcagaatagtcagaagtcacacacagagaaaatggatgtatcttacctttggtgaggagtaaattataaaaggactgtagctactttctgaaaggtaaaattgtcctgactcaaggatgaaaaggtatgtcaaaggggaatgttttataataatga

SEQ ID NO: 8794 - DNA, 601 bp, Human
ggagcagcagcggagagcacaggaaggcagtttcaggcagcctggcagacagctgtcagccactccaataacaattcctgcagccaatgaaaacgggcaggctctgtgcgggcagcctggccggaacaccaacaatgaaaacaagggattagagagcattctcagttaatggcttgagtgtcagggccaccagtctcccgggagccagtgctcccaaccagcaaggactggagaggaactgcagatgaaacaacacttcatttctctacaacactggccaagactttttttttttttttttgacatgcatgcatccacgctggctttatcctgacttatgaatccagcaaggcccacagaggaacatctggttttgacattaatttcttctactctgcaggatggttgggtttttaactcattgggggcctttggctagaccttgaatttcctggtgcaacttgacagaggtgagagggcttgagggagttaaataaaactatgtgctgcccttgaaaggacttgcaaatgctttatatattaaacaaagaaactccacttggatcaagctcttgacaaagatccaaccaattaggtaaac

SEQ ID NO: 8795 - DNA, 601 bp, Human
ctgacccccctcccccgacttccactctcctcttggtctgccgctgggactgtattttgtcgcttatctaacacaaaataaacagaacaatctggagctaatttaagtggtttaccatatcaggatacagctgggaaagattttaagaaaaggctcaacaggaacaatagcgctgtgaagtggagcagcagcggagagcacaggaaggcagtttcaggcagcctggcagacagctgtcagccactccaataacaattcctgcagccaatgaaaacgggcaggctctgtgcgggcagcctgkccggaacaccaacaatgaaaacaagggattagagagcattctcagttaatggcttgagtgtcagggccaccagtctcccgggagccagtgctcccaaccagcaaggactggagaggaactgcagatgaaacaacacttcatttctctacaacactggccaagactttttttttttttttttgacatgcatgcatccacgctggctttatcctgacttatgaatccagcaaggcccacagaggaacatctggttttgacattaatttcttctactctgcaggatggttgggtttttaactc

SEQ ID NO: 8796 - DNA, 601 bp, Human
tggaatgaggtgtgcgcagatgcaacgttaatgctcacctggcccatcagagtcacgtataaatggtcaggccagtgactgtatcatacttgtgcctctcacagttttgtctgggaactctaccttgtgttgtaaaagaccttgtgtcctctgacccccctcccccgacttccactctcctcttggtctgccgctgggactgtattttgtcgcttatctaacacaaaataaacagaacaatctggagctaatttaagtggtttaccatatcaggatacagctgggaaagattttaagaaaaggctcaacaggaacaatagcgctgtgaagtggagcagcagcggagagcacaggaaggcagtttcaggcagcctggcagacagctgtcagccactccaataacaattcctgcagccaatgaaaacgggcaggctctgtgcgggcagcctggccggaacaccaacaatgaaaacaagggattagagagcattctcagttaatggcttgagtgtcagggccaccagtctcccgggagccagtgctcccaaccagcaaggactggagaggaactgcagatgaaacaacacttcatttctctaca

SEQ ID NO: 8797 - DNA, 601 bp, Human
aggataattaaaagcagggggaagggggaagtcttgtggtaatcagggcatcaagcatggtacctggacagctggcatggcaaccaacctgacagcaatactgtgtctatttccaataatagaaatttagctcccttccagtgtagctgtatgctggggtcttgattttcttttctggaatgaggtgtgcgcagatgcaacgttaatgctcacctggcccatcagagtcacgtataaatggtcaggccagtgactgtatcatacttgtgcctctcacagttttgtctgggaactctacctygtgttgtaaaagaccttgtgtcctctgacccccctcccccgacttccactctcctcttggtctgccgctgggactgtattttgtcgcttatctaacacaaaataaacagaacaatctggagctaatttaagtggtttaccatatcaggatacagctgggaaagattttaagaaaaggctcaacaggaacaatagcgctgtgaagtggagcagcagcggagagcacaggaaggcagtttcaggcagcctggcagacagctgtcagccactccaataacaattcctgcagccaatgaaaacg

SEQ ID NO: 8798 - DNA, 601 bp, Human
tgaccctgttcttccctcgccttctctcaacgtggtggaaaagtgtttccaggactttggttcagagtgaggactggaggcccagccacactggagtgagtcatgagatctttcctggggagtcttgaattaccacatacaaaactctcagtaactgtcggaactcagctggttgctggttttgcttgcatgctttagctgcgttaaagcactcggtagtttatttttcatattttatttgggttaattcctaaaaatcacaaaggcagcgccttcatgctaggacagtatctattatatyttttaaaattttgttaagtattcaggaaggctttgcgtggactgctcctgttagaagacaaccacaaagcgggggaggccacgggtagagcggttgcacagatggcaagtgtaagcaaatagcggccaagtccattgtgaagtttcacttgcagctgtgtggaaaatacctatgctggtgactcaatgtctttggatttctagctttaaattacagcagagaagactcattttcaagtgctgagcatatagggagactggcaaatgtgggccagttttgagcccatcagttaccatacac

SEQ ID NO: 8799 - DNA, 601 bp, Human
ttgtgatacttgtcttgattttttttaaaccttcatctgaattgatacaggagcatacttcatgtcaggtaagaataaaaaaggaaacaattatttgacacaccttaattaagcacctgctaggtgcccgctactctgggaaaaggcaacaggggttcaacacatggtccctgctttcgagggaggcaacatccacagaaagcatagcctatgtgaaaaaatacaagactgtacacaactaagggcaaaaaagatacagagaaaggaaacaaggtaaaaactggggaattagaggtgacayggaggccgttcaagcccccagctagaccttgatggagaagacaaggcactttccatcagagggcaaggggatggggcggggtgattattattccaaagttggctttgtacctttttattacacagtgagtttgttttcccaaaaggaaagaaagagactgtttctaagggcatttgatcactcctgaccctgttcttccctcgccttctctcaacgtggtggaaaagtgtttccaggactttggttcagagtgaggactggaggcccagccacactggagtgagtcatgagatctttcct

SEQ ID NO: 8800 - DNA, 601 bp, Human
gcccatgattttaatgagaatgggctaagggaacttgtgatacttgtcttgattttttttaaaccttcatctgaattgatacaggagcatacttcatgtcaggtaagaataaaaaaggaaacaattatttgacacaccttaattaagcacctgctaggtgcccgctactctgggaaaaggcaacaggggttcaacacatggtccctgctttcgagggaggcaacatccacagaaagcatagcctatgtgaaaaaatacaagactgtacacaactaagggcaaaaaagatacagagaaagggaacaaggtaaaaactggggaattagaggtgacacggaggccgttcaagcccccagctagaccttgatggagaagacaaggcactttccatcagagggcaaggggatggggcggggtgattattattccaaagttggctttgtacctttttattacacagtgagtttgttttcccaaaaggaaagaaagagactgtttctaagggcatttgatcactcctgaccctgttcttccctcgccttctctcaacgtggtggaaaagtgtttccaggactttggttcagagtgaggactggaggcc

SEQ ID NO: 8801 - DNA, 601 bp, Human
ctttatatattttttctacactaatatttctgctctctttctggactctaatgacataaatgctagaccttttgatattattccataggtccctgcagcactgtttttcttccttttttctgtgtttcaggctgtataattttctttcttttccttctttcttttttttttttttttttgagagagggtctcactctgttgcccaggctggaatgcagtggcgctatctcagctcactgcaacctctgccctcctgggttcaagcagttctcctgcctcagcctcctgagtagctgggacracaggcgtgtgccaccacacctgactaatttttgtattttttggtagagatggggtttcatcatgttggccaggctggtcttgaactcctagccttaagcaatctgcccacctcagcctcccaaagtgctgggattacaggcacgagccaccacgaccagcccagactgtataatttctattgatctatcttgaagttcaccgactcttctttatcagctccattctgctattggacccatagagttaattttaaatttcagatattgtgtttttcagttctataattttcatttgtttt

SEQ ID NO: 8802 - DNA, 601 bp, Human
tgcaccaaatttgtgaagttttcacacattattcctttatatattttttctacactaatatttctgctctctttctggactctaatgacataaatgctagaccttttgatattattccataggtccctgcagcactgtttttcttccttttttctgtgtttcaggctgtataattttctttcttttccttctttcttttttttttttttttttgagagagggtctcactctgttgcccaggctggaatgcagtggcgctatctcagctcactgcaacctctgccctcctgggttcaagcarttctcctgcctcagcctcctgagtagctgggacaacaggcgtgtgccaccacacctgactaatttttgtattttttggtagagatggggtttcatcatgttggccaggctggtcttgaactcctagccttaagcaatctgcccacctcagcctcccaaagtgctgggattacaggcacgagccaccacgaccagcccagactgtataatttctattgatctatcttgaagttcaccgactcttctttatcagctccattctgctattggacccatagagttaattttaaatttcagatat

SEQ ID NO: 8803 - DNA, 601 bp, Human
atttttttttttcatctttagttttcagcagttccattatgatgctggtgtagttttctttgagtttatcctgtttggatttcactgagcttcttgaacttgtacatgtatcttgcaccaaatttgtgaagttttcacacattattcctttatatattttttctacactaatatttctgctctctttctggactctaatgacataaatgctagaccttttgatattattccataggtccctgcagcactgtttttcttccttttttctgtgtttcaggctgtataattttctttcttttcyttctttcttttttttttttttttttgagagagggtctcactctgttgcccaggctggaatgcagtggcgctatctcagctcactgcaacctctgccctcctgggttcaagcagttctcctgcctcagcctcctgagtagctgggacaacaggcgtgtgccaccacacctgactaatttttgtattttttggtagagatggggtttcatcatgttggccaggctggtcttgaactcctagccttaagcaatctgcccacctcagcctcccaaagtgctgggattacaggcacgagccacca

SEQ ID NO: 8804 - DNA, 601 bp, Human
ttcattacactactgagtagtagtccactgcacagaagtaccacatctgtttatctatttgctagttgaaggacatttgggtttttcagtttttagtaattatcaataaagatgctataaatatatgggtattgttttttgtgtgaacatgctttcattcaatttcattcaatcccatgaatgagattgctgctttcaaggtatttttttttttcatctttagttttcagcagttccattatgatgctggtgtagttttctttgagtttatcctgtttggatttcactgagcttcttgaayttgtacatgtatcttgcaccaaatttgtgaagttttcacacattattcctttatatattttttctacactaatatttctgctctctttctggactctaatgacataaatgctagaccttttgatattattccataggtccctgcagcactgtttttcttccttttttctgtgtttcaggctgtataattttctttcttttccttctttcttttttttttttttttttgagagagggtctcactctgttgcccaggctggaatgcagtggcgctatctcagctcactgcaacctctgccct

SEQ ID NO: 8805 - DNA, 601 bp, Human
aaaacatatgcctggcatatgaaacacaaaattcttttttggaaagctttctgtatgtatcagagaccatttcattatttattccatttttggcttcctgaaagtttatggaatcaaatggaaaatgacttcaaaatagataagagattacatgaatcttttctatacttcacatagtcatgaagatatattaaccatatcagatatgaaatcatgtgctggtgatttcattttaatttacatacagtaaaattcacttattttggtgtgcatcattatggattttgacaaatagagtcayataaataccaccacaatcaggatagaacattctatcactgtgatataactcctttgtaccacctctttgtagacaaattgtacacccagccttaacccctggcaaccactgatgcttctctgtcgttaaggttttgctttttccagaatgtcatataaaaaaatcatagtgtgtgtaatcttttcagtctggcttcctgcattcagcataatgcatttgtgattcatccatgctaatgtgtgtatcaacagttcattacactactgagtagtagtccactgcacagaagtaccacatctg

SEQ ID NO: 8806 - DNA, 601 bp, Human
agggagacgggggattactctgcctaccacaaacatgatgataaagtgatatttatcccaagactgcaatcaattttcaaatagaagaacagagttagaagaattatactatccaatttcaagaactactataaagctacagtaatcaagatttcatggaactggaatggagtgcctagtaaaacaaccacatttaaatggtcatttgctttttagcaagggtgccaaaccaaccaatagggaaatagttttttcaaaaaaaaataatgctagagtattctgatatctacgttaaaaaaaacaaacaaaaccttgacaaaccctacttcataacacacataaaaattaaagatgaatcatattacaactcaataataaaagataaccaaattaaaatattgacacaggatttaaatagacatttctctaaagaagatacacaaaaatagatggtcaatagatacacaaaaagatgtcccacattagtcatccaagaggcacaaactaaaaccataagaagataccactttatacccaataggattactatataacaaaaaagacagacaattgacaagtggtggtaaggacgtggagaaac

SEQ ID NO: 8807 - DNA, 601 bp, Human
taacatattcacaggttccaggctttagggcatgtttggaggcaggagggagacgggggattactctgcctaccacaaacatgatgataaagtgatatttatcccaagactgcaatcaattttcaaatagaagaacagagttagaagaattatactatccaatttcaagaactactataaagctacagtaatcaagatttcatggaactggaatggagtgcctagtaaaacaaccacatttaaatggtcatttgctttttagcaagggtgccaaaccaaccaatagggaaatagttttttmaaaaaaaaataatgctagagtattctgatatctacgttaaaaaaaacaaacaaaaccttgacaaaccctacttcataacacacataaaaattaaagatgaatcatattacaactcaataataaaagataaccaaattaaaatattgacacaggatttaaatagacatttctctaaagaagatacacaaaaatagatggtcaatagatacacaaaaagatgtcccacattagtcatccaagaggcacaaactaaaaccataagaagataccactttatacccaataggattactatataac

SEQ ID NO: 8808 - DNA, 601 bp, Human
ttctctgtggccctgggggctgtctcatcctcatacttgaactctgggttgttgctggtgaaaatctcaatgctatatatttgtttttggtcttctattgagggattgaagctggcttgcttctatactaccattttgaaatcctgcattccttgattcatgccctcttccttcaccttcaaagtcagcaatgggcgggcgcagtagctcacgcctgtaatcccagcactttgggaggcctaaggaggcagatcacgaggtcaggagatcgagaccatcctggctaacacagtgaagcccstctctactaaaaatacaaaaaaattagctgggcatggtagcgggcacctgtagtgccagctacttgggaggctgaggcaggagaatggtgtgaacccgggacctgggaggcagagcttgcagtgagccgagatcgcgccactgccctccagcctggcgacagagcaagactccgtctcaggaaaaaaaaaaaaaaaaaaaaagtcatcaatgatggttgaatccttttcatatcatattacccgacctcctcttctgcctccctcttccacttttaaggtcaccgattgcactggtccaa

SEQ ID NO: 8809 - DNA, 601 bp, Human
tgtccaggtacttaattttacctgtaggttttatactttgaaaagttttcttttgcacattagcgttttttctttcagactgaagaactgcctttagtatttcttgcaagatggatctagtggtggtgaattctctcagcttttgtttgtctgggaaagattttatctctcctttatatttgaatgataattttgctggatacaatattcttggatggcaggctttttttgtctctctttgagcaatctgaaaatgccattccactccctcctggcctgtttagtttccttagagtaatcygttgccacatgaattagagctactttacgtgttatttgcttcttttctctgctgcttttaggatcctctctttgtccttgacctttgagagtttcatttttctatgccttggagtagtcttatttgggtcaaatctgtttggtgttctctgacctttctgtagctggatatttctctttctcaagttttggaaagttttcagttcttatccttttgaatcaactttctaccccttgctctcgcttcactctctcttgaacaccaacagcagtaattcttagatttggtcttttgaggtaa

SEQ ID NO: 8810 - DNA, 601 bp, Human
acccagcagaatagggaccccagaggtactgcgttcagtgacagggtaaaaaagaagtaagttatattctttgcagatctaagtttgtgcactgaaatttgtgattactatgcatatgtgtgagcactatggctggatgtcctagacttgatggatataataattgtgttaggctattttgtaggcgaaatagaagttaaatccatttttattgttttggttattttgaagcagtaatatggactcattccaagactttacatttttatgtaatagcaactataatgataggaaaagtackgaaatcagaagaaagtttgtttctataacatgcctctcaggcttttcaaatctaacatccccacccttttcataacaaatattttgtgatgctcctttgtcctgaaatggaatttatatacaatactgtaactatatgtctaattaaaaaaaataactctcagtgtaatacagagtagaaaaaggcaattaataataaaatagcatgtatttcataggaaaatgcgcaggttcaaccctaaaagacatagcaaagtggttagatgagtgcatacagttatagacgaaataaatttggact

SEQ ID NO: 8811 - DNA, 601 bp, Human
gtctcccaggctggagtacagtggtgcaatcttggctcactgcaacctccgcctccagggttcaagcgattctcatgcctcaacttcctgagtagctgggtctacaggtgcccaccaccatgcccagctaatttttgcatttttagtgaagacagggtttcgccttgtcggccaggctggtcttgaactccagacctcaggtgattcatccacctcggcttcccatagtgctgggattacaggcagaagccaccacgcccagcctgcattctctattctataggtaatttcttgagaagtkcaacaacacagtgaattgtgaggggtgttgttactatcaggggagagccaggataactcctttctgttcccatgagtttaaataaaggacatcaattatcatagaaaaaaacactataacaatagcctgggattcaaattaaacaccagaaactgaagatttgttcaaatacacatttgattattcgtaggggtttaaaatggtttgcagcattcagggcagataagtgctctgaccaccagctcagacactaaccagactttacatcttgactaagagcaccagcaaggagaatgtcca

SEQ ID NO: 8812 - DNA, 601 bp, Human
acattgaatcatttctgacagaatgtgcatttgattctgccaagtctacctttaaaacagctttccaatcatccccccttctgcagcccattgctttaggtcaggcactcctctgtctgggctcctgggctaatttatataccgcttcaagttcccaccagaggtgtttgtaaaacccaaaatcaatcaggccacatgcatgtttaaagacctgattgctttccaatcagggaaaaagttccaacttcaggcccacatatagaatccttcatatctgcccccaacctcctttttgggtatyaactcctgtcctcccccataaaaagtgccctgagcttcagtcacgtagaactaacttctccctgttgttagaatatgtcatgccctttcatgctaattttgcctttgcacatgttggctcccttgcctaaagtgccacgggttaaagatcatatcttctgtgaacctgccacttagtgccctagatggtcttcatctctgctctgtatttctgctacattttatgtgcacattttctactatacttagctctgtctattgttaatcagttgttcatggctttgtcttccccatgaactct

SEQ ID NO: 8813 - DNA, 601 bp, Human
aattcaacataaaactggtaggagtagcaacaagaataaaataagctcttttgcaacaaggtggaaaagggagtttcctatattgctcactgaagtttgacataaattagaatttaaaaagacaatggaaccatcagcatttcaaagacgtttcttctcattttcccttctagttttatttttcggcaaaagttaatttctttcttgttaagaattcatattcaagagaaatttttgtttcatttcctgactgacatatgaaaaaaattccaaatcaaaataagatgacgccagctcctaraagaagcaaagaaacgttttttcagggagatggttttgcagcaatgttttggcacagggaaaatctaattataaggcctttactgtctagaaaagaaatgtcaaagtaagacaaacattatcatatacagaccgtaaatctcactttattattcactattgaacaaaaataactgtcaaaaagtcatggaaaaatattggtttgccaaagatctaagcaaaaacattaagtatatgacaatgaagcctcatccatatccagctgataaaaatcaaaatgaaaccatgacaacagcattaa

SEQ ID NO: 8814 - DNA, 601 bp, Human
tggcagggtacctgacacaacctaagtgctcaatacatggtagtaactgctgttgttcttaaaatttacaacaacccgaatagtttagtattataaccattttgtcacgttttttaaaaggaagtttgaaaaagccaaacagtgaatagatggcaatgctaggattccaacaaggtctgtgtgacaccccaggcctctgcccctagagcaccacactcctgctatccctagtatagagtgggctcacacatgtaggccacataaactttcacttcctgatgaaaaccacaagtacggtcarcctcagcaaagtgtacactcttcctatgagtgtacataggaagttatttcaaggtaatggtaattccttttagagaaggcttagctgctgttggggaagaaattcaaggctctactgccaaggaaacttttggtggcgcccttaacacaccagttctcagttcttttctgtgcttctcgaaagggagtagagaagagtcttgagttagatcaggtgaggaaacaattcttcaacacatgggtcggtgacagacaatctcatcatttgacatcacagacttacaagaatctttcttcaaac

SEQ ID NO: 8815 - DNA, 601 bp, Human
taagggaatttcacttagtgacttaatgctccttataggtggagacaaaaactgacctttttcttttcctcttggaaaaaaaattctacaatttaaactggaaaatgaattaacactctacactctggcaataatatctctttcttaagtgtgaaagctgagtatttctccagtggttgataaatgtctctgtaaacagaacattagatggaaaaatataattgtgaaaaaaatttttcccctcttgacaggatggtgaaataaagtttcattatgcacaataccagggaagagaaggttwctcttccaagacaacagaaggaatgggagatcttggcaaagacagggtagaagctactagagtaactgaagttaagtatcttcccagccaaatgagggctcagagttaagacattaaagtgggcagtagaaaagaaaaagtgccatttcttacatactggggttatagaatcatacaaactcccaaagtatccacagatttaggtgactttagagacacattttaaataacacatattttgcattaaactttaaaaaaaaaacccactattacccaaatgagccacatgagggcagtatg

SEQ ID NO: 8816 - DNA, 601 bp, Human
tgccacaaagcccacccctcggacgcctccttcccacaggctccattttcttcctcgaaggggccagttattaccccctgccaaagtctgccctccgttatctgaaacacagtaaggtcttggcatgaggatgatgttaactcttaaatacatttaagaacagagactgtatgtacattgttactaaatggtgcttaaataataaaaaaaaagaaaattccttgccttttcccaccctaaattcccttttcccattgacatagcctttcattattcagacataagtaaggcccagtgtgayacatatctacctttaaatcctccatggagagagccactggaaaacaaggcagtccctcgatgatatgcgctttggagatccctaagctaaacaatccactaaactttaaatacacctgtgtaactttgtatagcatgggagaatgagtccatggaagctgggaccctctccatgcatgaagagaaaactaagggaatttcacttagtgacttaatgctccttataggtggagacaaaaactgacctttttcttttcctcttggaaaaaaaattctacaatttaaactggaaaatgaatta

SEQ ID NO: 8817 - DNA, 601 bp, Human; identical to SEQ ID NO: 944

SEQ ID NO: 8818 - DNA, 601 bp, Human
gaacttgggaacaatagagattgaagatttgaagggtggatacttcatctacagaaggcagcagctatttgattctagtcagttgttggccttctggaaatgtgggtgcagtgctgtcagaccttcctatttttaaaacacttttatttggaaataatttcaaatttacaaaaagttgcaaaaataagacataacaaaagaatacttatgcaccttacctatattcttttatttaattttgcagtccatttgaattctctctgtgcacatgtacatacatacacacacacacacacacaccatttttttctgaaccatttgagggtatgttaaatatatcatggctttttgctcctaaatactccattgtgtatttcctataactagagacctgaaacctactattcttgagctgggatacctggagtgggatgaagagatggcctgaggaagtcctctccccctggccactaagggacagtcaatcagctgctaaccccaaacagagctgtaacaccaaacagaggttgaaaaccattgcactaggtcattccacccgtaaaaataatatctccaatatatgcatatttatttataaatt

SEQ ID NO: 8819 - DNA, 601 bp, Human
ataattgaaagaaggttataaagctaattaaatcagattttcccttgggtttgtaagagatgaggaccttccctagtctcacccttgtgggtgaggcccattagagaggaacccatagactccacgttgtgagaggttgagcggcctggctgaacacttcttctatccattcctgaactcacaggactttaaactttaatgtttaaacttgaatagctatcaaacttcctttgtaaaaactaatcttaggctgctgaaccctactattttttaacattaattattaattacagaaaaattrataatataaaaagataagaaataatctatatattttgcaactggaaattggtcaaagtatggtatttccagagtgttgaatactatgattatgttcagcagggactataaacttaaatgcctacagagactaagtaggtaacctaaatgagtgcagtggatctgtattggaacttgggaacaatagagattgaagatttgaagggtggatacttcatctacagaaggcagcagctatttgattctagtcagttgttggccttctggaaatgtgggtgcagtgctgtcagaccttcctatt

SEQ ID NO: 8820 - DNA, 601 bp, Human
gtcttaaaaagaaaaaaaaagaaaaaagaaatacatggaagaaactcaaaccacaacacctagaagaaaatagatatttagcacatttgaagctgagaaaaatatttctgaacaaaaaagcaagagaaaaacatttcattgacaaataaacatgggaaagacatccatgtagaagacataaacaaaataaaaagacaaaaaaaaaggaaaaatatttgcaagaaatacaacaatccaaaaacctgacataaagaagcaaacaaatccacaaaaaacacctacttttcagtaaaataagtgkaaaagcacatggaatgaatactttcaaagacaaaatacaaatggaatataaaaagttaaatattaatctccataataataaaaaatcaagttaatacaagactattttgtctataacattagcaaaggttttttaaaaagcttgataaggaaaagctatgaggaagatgagcactttctacacctgtacaagagtacattgatacagcctttttagaaagcagtttggtaatgtttatcaaatgcttttaaaatcatgtaggggccacccttggccctccgcaagttcactgaaaaatca

SEQ ID NO: 8821 - DNA, 601 bp, Human
ttgaaagttgatgataaactgaattaaagttcaagatttgctttgcttggaaatctttgttttatttttaccatgaagtgggcattaagttttgcattaaaataagcaaaaggggcataggcttgtaaagaatgttttagaaaagaatgtgtaatcaatttctaatatcacaaaataggtaatatctagatttttgtgcctatgtttaggtacttttttcctgtaagttcatagttttcatcggtcttaaagaggcctacaatcttaaaaaactgcaaaaaacattactcctctgatttaracactgacctcacataacacgcacaccatcttgcaacaatttaagaattatggctgagcacaatggctcacacctgtaattccagcgctttgggaggccaaggcaggtggatcacttgaggccaggagttcaagactggttggaccaacatggcaaaacccaggctctactaaaaatacaaaaattagctgggtatgttgatgcatacctgtaattccaactactcgggaagctgagacatgagaaccgcttgaacccaggaggcagagatcgcagtgagccaagatcatatcactgcac

SEQ ID NO: 8822 - DNA, 601 bp, Human
gcctcccatagtgctgggattataggcgtgagccaccacgcctagtctgcttatgttttacattgtttaattaaatataaaataattaaaaagaaacttgcaaggttttaatcctttggttttcctttttgtcaatcaaccttatgaaatgtcttcaaacaacctataggctgattattgagctgaaaagcagaaaaactacacagaattggaaattgcttagagaagtcatgtcccctagaaatggcaaacatagtctgtggcttggaacaaagaaaaactgaagcagtcgaaggagctsctattgtaaataatgtcacccactccagaactactatttcttctaacattttaatattttgaagcagtcctaagagaaatttgtaactatacagctaataaaacttctgatgctctcagcacagacaactgtttttcatccgttactggcattcctatttcacgagcctcttcaaattttcaaaaactaccatcatctcgaaagtggtatttccatttctggaaaaaagtttcagacctctgggcacagatcgggtgtctctgacatttggctgtccatttgtttttgctgctttggaaa

SEQ ID NO: 8823 - DNA, 601 bp, Human
atcaggagattgcttttttttttcctgaaacaggatcttgctctgttgcccaggctggagtgcagtggcatgatcacaactcactgtagcctcaagctcctgggctcaagtgaacctcctgcctcagcctcctgagtagctgggactacaggtgtgtgccaacacacccagctaatttttgtattttttgtagagacagggtttcgctatgttgcccaggctggtctcgaactcctgggctcaagcaatcctccctcctcggcctcccatagtgctgggattataggcgtgagccaccacrcctagtctgcttatgttttacattgtttaattaaatataaaataattaaaaagaaacttgcaaggttttaatcctttggttttcctttttgtcaatcaaccttatgaaatgtcttcaaacaacctataggctgattattgagctgaaaagcagaaaaactacacagaattggaaattgcttagagaagtcatgtcccctagaaatggcaaacatagtctgtggcttggaacaaagaaaaactgaagcagtcgaaggagctgctattgtaaataatgtcacccactccagaactactattt

SEQ ID NO: 8824 - DNA, 601 bp, Human
atattcagttgtcaccactgtcatgttatgacatcttaaagtgtttcccattgatgataaaaaagaaattcctatcattatgatcaggagattgcttttttttttcctgaaacaggatcttgctctgttgcccaggctggagtgcagtggcatgatcacaactcactgtagcctcaagctcctgggctcaagtgaacctcctgcctcagcctcctgagtagctgggactacaggtgtgtgccaacacacccagctaatttttgtattttttgtagagacagggtttcgctatgttgcccasgctggtctcgaactcctgggctcaagcaatcctccctcctcggcctcccatagtgctgggattataggcgtgagccaccacgcctagtctgcttatgttttacattgtttaattaaatataaaataattaaaaagaaacttgcaaggttttaatcctttggttttcctttttgtcaatcaaccttatgaaatgtcttcaaacaacctataggctgattattgagctgaaaagcagaaaaactacacagaattggaaattgcttagagaagtcatgtcccctagaaatggcaaacatagtc

SEQ ID NO: 8825 - DNA, 601 bp, Human
gccttgaaaaactcacaggctgctgtgagaaggtttgactagagaggatttgactcagcagtggagtataattagctgtagactgagcactgctctgcagttgcctaataaatcctaaaagcaatgctcaaaacgatcaaactgtttccaaataacttaactgcatctcagaacaaagccagaagctttatttttatttatttatttatttattttgaggcagggtctcagtctgttgctcaggttggagtgcagtggtgcaatctcggatcactgcaacctctgcctcccgggttcaagygattctcctgcctcagcctcccgagtagctgggatcacaggcgcccgccaccatgctcagctaatttttatatttttattagagacggggtttcaccatgttggccaggatagtcttgaactcttgacctcaggtgatccacccgccttggcctcccaaagtgctgggattacaggtgtgagccaccacaccctgcctagctagaagctttacaagaatacaaaaatatccagcactcaacagggtaaaatgtacaatgcttggcattgaatcaaagaccaaaagggatagaaatatgac

SEQ ID NO: 8826 - DNA, 601 bp, Human
ccatcagccagccttgaaaaactcacaggctgctgtgagaaggtttgactagagaggatttgactcagcagtggagtataattagctgtagactgagcactgctctgcagttgcctaataaatcctaaaagcaatgctcaaaacgatcaaactgtttccaaataacttaactgcatctcagaacaaagccagaagctttatttttatttatttatttatttattttgaggcagggtctcagtctgttgctcaggttggagtgcagtggtgcaatctcggatcactgcaacctctgcctccygggttcaagcgattctcctgcctcagcctcccgagtagctgggatcacaggcgcccgccaccatgctcagctaatttttatatttttattagagacggggtttcaccatgttggccaggatagtcttgaactcttgacctcaggtgatccacccgccttggcctcccaaagtgctgggattacaggtgtgagccaccacaccctgcctagctagaagctttacaagaatacaaaaatatccagcactcaacagggtaaaatgtacaatgcttggcattgaatcaaagaccaaaagggata

SEQ ID NO: 8827 - DNA, 601 bp, Human
acattcaaacataaatacattcaacatattacattcaaacaaaaataatattaataatatacagaattcttgttaaatcctttctgctcaagatgctgtagacgttagtttattgtctactggtgagtattattatagcaaagtgaaccaggtaaaggcaaacaaaaacaagacaggattgcagttttggtatttgacaaggtggagtttatgccaacattgttggtaagtatcatgatcgaaagatgaaataaatacattctttcatttttaacaataattatttatattattattattwttttttttgagacagagtctcgctcttttacccaggctgaagtgcagcggcgcaatctcggctcactgcaacttccacctcatgggttcaagcgattctcctccctcagtctcccaagtagctgggactacaggtgtgtgccaccacacccagtcaacttttgtatttttggtagaggcagggtttcaccaggttggccagcctggtctcaaactcctgacctcaagtgatctacctgcctcaggctcccaaagtattgggattacaggcataagccactgcgcctgacctatattacta

SEQ ID NO: 8828 - DNA, 601 bp, Human
acatggttcaaagaaaaaaatcaccatttgcaccattccccatagaatacattctttcaaatgaaagaactcaaacataaataattacattcaaacataaataatattaatattctaacattcaaacataaatacattcaacatattacattcaaacaaaaataatattaataatatacagaattcttgttaaatcctttctgctcaagatgctgtagacgttagtttattgtctactggtgagtattattatagcaaagtgaaccaggtaaaggcaaacaaaaacaagacaggattgcarttttggtatttgacaaggtggagtttatgccaacattgttggtaagtatcatgatcgaaagatgaaataaatacattctttcatttttaacaataattatttatattattattatttttttttttgagacagagtctcgctcttttacccaggctgaagtgcagcggcgcaatctcggctcactgcaacttccacctcatgggttcaagcgattctcctccctcagtctcccaagtagctgggactacaggtgtgtgccaccacacccagtcaacttttgtatttttggtagaggcaggg

SEQ ID NO: 8829 - DNA, 601 bp, Human
ggaggattgcttgagcccaggagtttgagaccagctgaggcaacatagtgagaccctgcctctacaaaataaaaatttaaaaattagctggttatagcagtacatgcctgtagtgccagctacttgggaggctggggtggaaggattgcttgagcccaggaggcagaagttgcagtgagctatgattgcaccactgcactctagcttgggtgacaaattgagaccttgtctctgttaaaaaacaataataataattgaaataataaaaagcatttcaattatttgtggtcctcaaaaccamaactgaaataaactagaaatcaataatttaactagggaaaaacccaaaatttggaaacttaacaatgcacttctaaatacatggttcaaagaaaaaaatcaccatttgcaccattccccatagaatacattctttcaaatgaaagaactcaaacataaataattacattcaaacataaataatattaatattctaacattcaaacataaatacattcaacatattacattcaaacaaaaataatattaataatatacagaattcttgttaaatcctttctgctcaagatgctgtagacgt

SEQ ID NO: 8830 - DNA, 601 bp, Human
ctaagtaagaaaaaagggactaaggaattatataaagatatttgtataatgataaacagtaggataaaatataaatttttctaaatattaaagaactactaaataaaaggtcaaagataaaaagtaaatgtaacaaaacaatgaaaaaactaagaatagaaataaaaatatttataaatatgtataaattcatctactaaaacattacagactggatcataaagaaaaacctaacactatacttaacaactacagaatacgcattcttttcaattacacctgatgtggacaacaagaaagwccatctactaggccaagtctcaaatttaaaacaattagcccaggagtgatggctcacacctgtaatcccagcgctttgggaggctgaggcaggaggattgcttgagcccaggagtttgagaccagctgaggcaacatagtgagaccctgcctctacaaaataaaaatttaaaaattagctggttatagcagtacatgcctgtagtgccagctacttgggaggctggggtggaaggattgcttgagcccaggaggcagaagttgcagtgagctatgattgcaccactgcactctagcttgg

SEQ ID NO: 8831 - DNA, 601 bp, Human
gttacataagttgcttgatttccttatgggtaataagtggaagctgaagatgtcatttaaatgtgacaaaccaaatagtggaacctaagtaagaaaaaagggactaaggaattatataaagatatttgtataatgataaacagtaggataaaatataaatttttctaaatattaaagaactactaaataaaaggtcaaagataaaaagtaaatgtaacaaaacaatgaaaaaactaagaatagaaataaaaatatttataaatatgtataaattcatctactaaaacattacagactggawcataaagaaaaacctaacactatacttaacaactacagaatacgcattcttttcaattacacctgatgtggacaacaagaaagaccatctactaggccaagtctcaaatttaaaacaattagcccaggagtgatggctcacacctgtaatcccagcgctttgggaggctgaggcaggaggattgcttgagcccaggagtttgagaccagctgaggcaacatagtgagaccctgcctctacaaaataaaaatttaaaaattagctggttatagcagtacatgcctgtagtgccagctactt

SEQ ID NO: 8832 - DNA, 601 bp, Human
actatgtgaaaagaccaaatctacgtctgattggtgtacctgaaagtgatgcggagaatggaaccaagttggcaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagyggatctcttggcagaaaccctacaagccagaggagagtgggggccaatattcaacattcttaaagaaaagaattttcaacccagaatttcatatccagccaaactaagcttcataagtgaaggagaaataaaatactttacagacaagcaaatgctgaccgattttgtcaccaccaggcctgccctaaaagagctcctgaaggaagcactaaacatggaaaggaacaaccggtaccagccgctgcaaaatcatgccaaaatgtaaagacctgcgagactaggaagaaactgcatcaacta

SEQ ID NO: 8833 - DNA, 601 bp, Human
agctgagggtcctgtctgttagaaggaaaactcacaaacagaaaggacaccgaaaacccatctgtacatcaccatcatcaaagaccaaaagtagataaaaccacaaaggtggggaaaaaacagaacagaaaaactgggaactctaaaacgcagagcgcctctcctcctccaaaggaacgcagttcctcaccagcaatggaacaaagctggatggagaatgattttgacgagctgagagaagaaggcttcagacgatcaaattactctgagctacggaaggacattcaaaccaaaggcaaasaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcaagaagggacgtttagagaaaaaagaataaaaagaaatgagcaaagcctccaagaaatatgggactatgtgaaaagaccaaatctacgtctgattggtgtacctg

SEQ ID NO: 8834 - DNA, 601 bp, Human
aaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagccttgaagagagcagtggttctcccagcacgcagctggagatctgagaacgggtagactgcctccacaagtgggtccctgacccctgacccccgagcagcctaactgggaggcaccccccagcaggggcacactgacacctcacacggyagggtattccaacagacctgcagctgagggtcctgtctgttagaaggaaaactcacaaacagaaaggacaccgaaaacccatctgtacatcaccatcatcaaagaccaaaagtagataaaaccacaaaggtggggaaaaaacagaacagaaaaactgggaactctaaaacgcagagcgcctctcctcctccaaaggaacgcagttcctcaccagcaatggaacaaagctggatggagaatgattttgacgagctgagagaagaaggcttcagacgatcaaattactctgagctacggaag

SEQ ID NO: 8835 - DNA, 601 bp, Human
ggtcactcccacccgaatattgcgcttttcagactggcttaaaaaacggcgcaccacgagactatatcccacacctggctcggagggtcctacacccacggaatctcgctgattgctagcacagcagtctgagatcaaactgcaaggcggcagcgaggctgggggagaggcgcccgccattgcccaggcttgcttaggtaaacaaagcagccgggaagctcgaactgggtggagcccaccacagctcaaggaggcctgcctgcctctgtaggctccacctctgggggcagggcacagacawacaaaaagacagcagtaacctctgcagacttaaatgtccctgtctgacagccttgaagagagcagtggttctcccagcacgcagctggagatctgagaacgggtagactgcctccacaagtgggtccctgacccctgacccccgagcagcctaactgggaggcaccccccagcaggggcacactgacacctcacacggtagggtattccaacagacctgcagctgagggtcctgtctgttagaaggaaaactcacaaacagaaaggacaccgaaaacccatctgtacatcaccatcatca

SEQ ID NO: 8836 - DNA, 601 bp, Human
aatagggacagttccggtctacggctcccagcatgagcgacgcagaagacgggtgatttctgcatttccatctgaggtaccgggttcatctcaccagggagtgcaagacagtgggcgcaggccagtgggtgcgcacaccgtgcgcgagccaaagcagggcgaggcattgcctcacctgggaagcgcaaggggtcagggagttccctttccgagtcaaagaaaggggtgacagacgcacctggaaaatcgggtcactcccacccgaatattgcgcttttcagactggcttaaaaaacggcgyaccacgagactatatcccacacctggctcggagggtcctacacccacggaatctcgctgattgctagcacagcagtctgagatcaaactgcaaggcggcagcgaggctgggggagaggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagc

SEQ ID NO: 8837 - DNA, 601 bp, Human
aaaccatatcaaggggaaaggactcaaataacgtctgataagataaactccagaaagagaaggtcacacccaagggacaaaatgttgatagaggtctcatacctgacagatcaaagcactggctagtggggagtcaaaagggagtccaaggaagtagcttggataaggaagtgtgcaggacgagagtggctgccttgggcagctgagatgctgagagaggagcagctgaagaacaagtgtcctttggaagatggatggtaaagggaaggaaggacatggccaaagatcagggttccattawaataacacagtgtcagagaatcatgagaaggcagaccaaaaagaaaggggctgagccaagatggccgaatagggacagttccggtctacggctcccagcatgagcgacgcagaagacgggtgatttctgcatttccatctgaggtaccgggttcatctcaccagggagtgcaagacagtgggcgcaggccagtgggtgcgcacaccgtgcgcgagccaaagcagggcgaggcattgcctcacctgggaagcgcaaggggtcagggagttccctttccgagtcaaagaaaggggtgacaga

SEQ ID NO: 8838 - DNA, 601 bp, Human
atgggaattcaagatgagatttgggtggggacacagccaaaccatatcaaggggaaaggactcaaataacgtctgataagataaactccagaaagagaaggtcacacccaagggacaaaatgttgatagaggtctcatacctgacagatcaaagcactggctagtggggagtcaaaagggagtccaaggaagtagcttggataaggaagtgtgcaggacgagagtggctgccttgggcagctgagatgctgagagaggagcagctgaagaacaagtgtcctttggaagatggatggtaaasggaaggaaggacatggccaaagatcagggttccattataataacacagtgtcagagaatcatgagaaggcagaccaaaaagaaaggggctgagccaagatggccgaatagggacagttccggtctacggctcccagcatgagcgacgcagaagacgggtgatttctgcatttccatctgaggtaccgggttcatctcaccagggagtgcaagacagtgggcgcaggccagtgggtgcgcacaccgtgcgcgagccaaagcagggcgaggcattgcctcacctgggaagcgcaaggggtca

SEQ ID NO: 8839 - DNA, 601 bp, Human
gtattagtccgttttcatgctgctgataaagacatccccaagactggacaatttacaaaagaaagaggattaattggactacagttacacatggctggcgaagcctcacaatcatggtggaaggcaaggaggagcaagtcccatcttacatggatggcagcaggcaaagagagaatgaggaagatgcaaaaggagaaacccctgacaaaaccatcagatctcatgagacttattcactaccacgagaacagtatggaggaaactgcccccatgattcaattatctgccaccgggtccctcmcatgacacatgagaattatgggagtacagttccagatgagatctggtggggacacagagccaaaccatatcattccacccctggcccctcccaaatctcatgtcctcccatttcaaaaccaatcatgccttcccaacagtcccccaaagtcttaacttgtttcagcattaactcaaaagtccacattccaaagtctcatctgagacaaggcaagtcccttatgcctatgagcctgtaaaatcaaaagcaagctagttatttcctaaatacaagggggatacagacattgggtaaatccga

SEQ ID NO: 8840 - DNA, 601 bp, Human
aaaccaaacactgcatgttctcactcataggtgggaattgaacaatgaggacacttggacacggggcggggaacatcacacactggggcctgttgtggggtggggggtgggggtagggatggcattaagagaaatacctattgtaaatgatgtgttaatgggtgcaggacaccaacatggcacatgtatacatatgtaacaaacctgcacattgtgcacatgtaccctagaacttaaagtataataataataaaaaaaaatagatagtcacttcatagtctttgcatgcagggctactgaytgttgttcctatcatctttatttcataaaccatatctataatgttttatctatagtttctagtgctgtttttcttaaagtggaataagaacctaagaacatgtgaatttttagattttcatagaataatggtggccatctaaatttaaaatcccttcatacattctctttaaaaaccatattgataaagaaagaaagtaatatcaaccaaagcagaagcctatgacacaagcaggagacaaggcctatttaaaccctgggtgaagtgaggaaacaaccctctgagacctgaagagtcagg

SEQ ID NO: 8841 - DNA, 601 bp, Human
gcctataacaaccaaactagttattttggggtttcatttgttttggctaggctagtttggataacagtagcttgcactgatagaacattttttatgtgcaacacaccatttaaaatactttacacgtatcatttcattcaaccttcaacactgtgaggtagagacaagcttggcatggcatggttaagtgacttacacaatcatgtggttgagcaggtgacaggactgggtttggagctcaggcagactgacccccaaatcccatctctaaccttctatgctaaattctctgctcagtaaratgtacacatggcctcagtgtctccttgaatgtatggtgtttccattcatttggtttatttttaaggctccataaacaaatatctctattaactgcaaatgcttctattaataaaagttaaacatttttcttcaccctcttctcttgaaaacttataaagtagtatatcattgtctctgatgatattttcagtattctgtttgaatttaccccaaatttcacatttgctagagtatttttatttacaaaaacagggcaaggagacagccactgaccagtgaccagtttccaatatgctat

SEQ ID NO: 8842 - DNA, 601 bp, Human
ggtgtttttattacagcaaatacttgggctccaggcttataggaacaaagcagagctctctaattagcttctttaaggtaggcacccatgggacagttcaaggattgccaccgtacaatgtttacccccatcccagcacatattattggctatggcagtaagtagacaaagacctatgtaaagaaaataacagaactatcttgtttgccatttgccacttagtgatgaagacctacctctaaaccggtgaagttggcaagttttacccatgcctataacaaccaaactagttattttgggktttcatttgttttggctaggctagtttggataacagtagcttgcactgatagaacattttttatgtgcaacacaccatttaaaatactttacacgtatcatttcattcaaccttcaacactgtgaggtagagacaagcttggcatggcatggttaagtgacttacacaatcatgtggttgagcaggtgacaggactgggtttggagctcaggcagactgacccccaaatcccatctctaaccttctatgctaaattctctgctcagtaaaatgtacacatggcctcagtgtctccttgaa

SEQ ID NO: 8843 - DNA, 601 bp, Human
gatgttctctccaatatgagagtctctttttggaaaaatatcagtgtcaatatagtcaagtcacacagtctactcattatagactgtatattaaaaaatacatattgcaatctgttatctaggtattttccttattttttggttttggtagatgctatagtttagctgcatgagcaatactgtctttatcagattgttgattttatttgtgaaataaaaatctctaaataatgactgacggtgttaatgataaacgggttttcaataatcacacaagttcatgaaatgtcctggttttacrtgaatcaaggtaatgggtgtttttattacagcaaatacttgggctccaggcttataggaacaaagcagagctctctaattagcttctttaaggtaggcacccatgggacagttcaaggattgccaccgtacaatgtttacccccatcccagcacatattattggctatggcagtaagtagacaaagacctatgtaaagaaaataacagaactatcttgtttgccatttgccacttagtgatgaagacctacctctaaaccggtgaagttggcaagttttacccatgcctataacaaccaa

SEQ ID NO: 8844 - DNA, 601 bp, Human
gaaacacactggggtagatgtaattttaatttctaagacattttatgatgttctctccaatatgagagtctctttttggaaaaatatcagtgtcaatatagtcaagtcacacagtctactcattatagactgtatattaaaaaatacatattgcaatctgttatctaggtattttccttattttttggttttggtagatgctatagtttagctgcatgagcaatactgtctttatcagattgttgattttatttgtgaaataaaaatctctaaataatgactgacggtgttaatgataaaygggttttcaataatcacacaagttcatgaaatgtcctggttttacgtgaatcaaggtaatgggtgtttttattacagcaaatacttgggctccaggcttataggaacaaagcagagctctctaattagcttctttaaggtaggcacccatgggacagttcaaggattgccaccgtacaatgtttacccccatcccagcacatattattggctatggcagtaagtagacaaagacctatgtaaagaaaataacagaactatcttgtttgccatttgccacttagtgatgaagacctacctc

SEQ ID NO: 8845 - DNA, 601 bp, Human
agacacaagaataatatgaagataaaatgaaacattaatattcctacctattcttcttgctggcaagtgctccctttatgaaacacactggggtagatgtaattttaatttctaagacattttatgatgttctctccaatatgagagtctctttttggaaaaatatcagtgtcaatatagtcaagtcacacagtctactcattatagactgtatattaaaaaatacatattgcaatctgttatctaggtattttccttattttttggttttggtagatgctatagtttagctgcatgagcwatactgtctttatcagattgttgattttatttgtgaaataaaaatctctaaataatgactgacggtgttaatgataaacgggttttcaataatcacacaagttcatgaaatgtcctggttttacgtgaatcaaggtaatgggtgtttttattacagcaaatacttgggctccaggcttataggaacaaagcagagctctctaattagcttctttaaggtaggcacccatgggacagttcaaggattgccaccgtacaatgtttacccccatcccagcacatattattggctatggcagta

SEQ ID NO: 8846 - DNA, 601 bp, Human
tttccatacaatcatcagaaaatgaactttcctcctgaccaatttctgaagacatcactctctcataagaagtatagcattgtctttgggagcaaagcctttcagggtgtgcatcccaactccagaaattactggctatataaacttgggtgttgtttttctcatcagcagaatctagataaaagtacctatcttacagagttgttatgagaattgcatgaggcaacaaaagcccttttattgtaaaatatagatccagattctgcagacatggaaataatataacctcaaagactataayctgggacacagacacaagaataatatgaagataaaatgaaacattaatattcctacctattcttcttgctggcaagtgctccctttatgaaacacactggggtagatgtaattttaatttctaagacattttatgatgttctctccaatatgagagtctctttttggaaaaatatcagtgtcaatatagtcaagtcacacagtctactcattatagactgtatattaaaaaatacatattgcaatctgttatctaggtattttccttattttttggttttggtagatgctatagtttagc

SEQ ID NO: 8847 - DNA, 601 bp, Human
cataacacagtttcagcaatatcaactcttgtgatcacttgtgatcttgcagaataaacagtggccctatcagaaccataaaatggttgtggggttgattattgctatactataatcatgtgttagcttctatcttctctatgtctctctctacacacacacacatatatgcatgtattcatttttaggtaatgctacaaatactatagtattccaggacatcatacagttccaaagtttcatttccatacaatcatcagaaaatgaactttcctcctgaccaatttctgaagacatcacwctctcataagaagtatagcattgtctttgggagcaaagcctttcagggtgtgcatcccaactccagaaattactggctatataaacttgggtgttgtttttctcatcagcagaatctagataaaagtacctatcttacagagttgttatgagaattgcatgaggcaacaaaagcccttttattgtaaaatatagatccagattctgcagacatggaaataatataacctcaaagactataacctgggacacagacacaagaataatatgaagataaaatgaaacattaatattcctacct

SEQ ID NO: 8848 - DNA, 601 bp, Human
atatatgccatatagggatattagtaccttgaacacaaagctttatcacaatgacacaatttcttccacaaaggtgtgtataccaaagtgggttggagaaaaagtgtatgttgtatgttcataacacagtttcagcaatatcaactcttgtgatcacttgtgatcttgcagaataaacagtggccctatcagaaccataaaatggttgtggggttgattattgctatactataatcatgtgttagcttctatcttctctatgtctctctctacacacacacacatatatgcatgtattcayttttaggtaatgctacaaatactatagtattccaggacatcatacagttccaaagtttcatttccatacaatcatcagaaaatgaactttcctcctgaccaatttctgaagacatcactctctcataagaagtatagcattgtctttgggagcaaagcctttcagggtgtgcatcccaactccagaaattactggctatataaacttgggtgttgtttttctcatcagcagaatctagataaaagtacctatcttacagagttgttatgagaattgcatgaggcaacaaaagccctttta

SEQ ID NO: 8849 - DNA, 601 bp, Human
ttcttcaacttcattcttctgcatgtgggtagccagttatcccagcactatttttttgaaaggactattttttccaatagtcttttcaatagttccaatggaactatcttggcacccttgtcaaaaatgcaatctgattttaacccacatctaagattaagaatcactgctctctggccttgttatagaggtcaccatatgtgattacatgttctaaattcttgattttgttcctatagagcaaaagatgggtatctagcttttaggacacttaggtaagaagtccatatataatgataayggcttccccttgaaaacaagtcctggtttcccagaaagtatcttaagaaatctgttgataactttctataatcaatatcttaatatatgccatatagggatattagtaccttgaacacaaagctttatcacaatgacacaatttcttccacaaaggtgtgtataccaaagtgggttggagaaaaagtgtatgttgtatgttcataacacagtttcagcaatatcaactcttgtgatcacttgtgatcttgcagaataaacagtggccctatcagaaccataaaatggttgtggggttgat

SEQ ID NO: 8850 - DNA, 601 bp, Human
tctagtctaccatcttgctgatgtcatgcttcttcaacttcattcttctgcatgtgggtagccagttatcccagcactatttttttgaaaggactattttttccaatagtcttttcaatagttccaatggaactatcttggcacccttgtcaaaaatgcaatctgattttaacccacatctaagattaagaatcactgctctctggccttgttatagaggtcaccatatgtgattacatgttctaaattcttgattttgttcctatagagcaaaagatgggtatctagcttttaggacacttaggtaagaagtccatatataatgataacggcttccccttgaaaacaagtcctggtttcccagaaagtatcttaagaaatctgttgataactttctataatcaatatcttaatatatgccatatagggatattagtaccttgaacacaaagctttatcacaatgacacaatttcttccacaaaggtgtgtataccaaagtgggttggagaaaaagtgtatgttgtatgttcataacacagtttcagcaatatcaactcttgtgatcacttgtgatcttgcagaataaacagtggccctat

SEQ ID NO: 8851 - DNA, 601 bp, Human
attcccagctgcttccaattggggttagggtaatggaggcctggcatttcttcccattctctatgtggccatcccaagtttctgtgctcaccagggtatctgttacttctcttgtgcaccactgtgctcctcctcagttatttttgttaaaatgaagttgtttattcattgttctggctatctttttgagggagaatagcactagggtcttctagtctaccatcttgctgatgtcatgcttcttcaacttcattcttctgcatgtgggtagccagttatcccagcactatttttttgaaargactattttttccaatagtcttttcaatagttccaatggaactatcttggcacccttgtcaaaaatgcaatctgattttaacccacatctaagattaagaatcactgctctctggccttgttatagaggtcaccatatgtgattacatgttctaaattcttgattttgttcctatagagcaaaagatgggtatctagcttttaggacacttaggtaagaagtccatatataatgataacggcttccccttgaaaacaagtcctggtttcccagaaagtatcttaagaaatctgttgataa

SEQ ID NO: 8852 - DNA, 601 bp, Human
ggcttagcctcagggataaaagagagccatgcatacttgcccccagagcaagacacatccagccatagttccaactccaagatggcatagcatggtagctatgtgggccacagggtgtggatcatagtattggctccttctctgggggaagcacggacatgtggacttcaggcagctccctcagctaggcttagtgcctgtgaggattgcaggggaccccagtgctcaggtctgtaggtatccacggtgttgatggggctgctgggatccttttgtttacctccttgcagtagggaaacgytcctcctagttcattcccagctgcttccaattggggttagggtaatggaggcctggcatttcttcccattctctatgtggccatcccaagtttctgtgctcaccagggtatctgttacttctcttgtgcaccactgtgctcctcctcagttatttttgttaaaatgaagttgtttattcattgttctggctatctttttgagggagaatagcactagggtcttctagtctaccatcttgctgatgtcatgcttcttcaacttcattcttctgcatgtgggtagccagttatcccagcact

SEQ ID NO: 8853 - DNA, 601 bp, Human
gtgggaggtggagcagctccacctctgcttggccccacaggggagcacaaaacagttgctcgacttggggatgtcaggccattgggctggggcagttcagcaatggcttagcctcagggataaaagagagccatgcatacttgcccccagagcaagacacatccagccatagttccaactccaagatggcatagcatggtagctatgtgggccacagggtgtggatcatagtattggctccttctctgggggaagcacggacatgtggacttcaggcagctccctcagctaggcttagtgyctgtgaggattgcaggggaccccagtgctcaggtctgtaggtatccacggtgttgatggggctgctgggatccttttgtttacctccttgcagtagggaaacgttcctcctagttcattcccagctgcttccaattggggttagggtaatggaggcctggcatttcttcccattctctatgtggccatcccaagtttctgtgctcaccagggtatctgttacttctcttgtgcaccactgtgctcctcctcagttatttttgttaaaatgaagttgtttattcattgttctggctatctt

SEQ ID NO: 8854 - DNA, 601 bp, Human
gactgctctgggtggaccaggcaccatttccctaggatgcagcgtgctgctttgacttaggcattggaggggcatgatttctctgagcagtcaaagtactgttttcccaggaatcaggacactgcttcagctctggcctgaggaggaaagggtggtgggaggtggagcagctccacctctgcttggccccacaggggagcacaaaacagttgctcgacttggggatgtcaggccattgggctggggcagttcagcaatggcttagcctcagggataaaagagagccatgcatacttgcccmcagagcaagacacatccagccatagttccaactccaagatggcatagcatggtagctatgtgggccacagggtgtggatcatagtattggctccttctctgggggaagcacggacatgtggacttcaggcagctccctcagctaggcttagtgcctgtgaggattgcaggggaccccagtgctcaggtctgtaggtatccacggtgttgatggggctgctgggatccttttgtttacctccttgcagtagggaaacgttcctcctagttcattcccagctgcttccaattggggttaggg

SEQ ID NO: 8855 - DNA, 601 bp, Human
gataccatgtcagcacagccctgggatttgcagctattcagctcagccagggtacaaattccccagagggtgatgtgtcatttcggcttgagtccaacaggtatgactgctctgggtggaccaggcaccatttccctaggatgcagcgtgctgctttgacttaggcattggaggggcatgatttctctgagcagtcaaagtactgttttcccaggaatcaggacactgcttcagctctggcctgaggaggaaagggtggtgggaggtggagcagctccacctctgcttggccccacagggragcacaaaacagttgctcgacttggggatgtcaggccattgggctggggcagttcagcaatggcttagcctcagggataaaagagagccatgcatacttgcccccagagcaagacacatccagccatagttccaactccaagatggcatagcatggtagctatgtgggccacagggtgtggatcatagtattggctccttctctgggggaagcacggacatgtggacttcaggcagctccctcagctaggcttagtgcctgtgaggattgcaggggaccccagtgctcaggtctgtaggt

SEQ ID NO: 8856 - DNA, 601 bp, Human
tgcctcgccctgcttaggcttgcgcatggtgcgctgcacccactgtcctgtgcccactgtcttgcactccctagtgagatgaatccggtacctcagagggaaatgcagaaatcacccgtcttctgtgtcgctcacgctgggagctgtagaccggagctgttcctattcagccatcttggctgccagatctccgtgaattttgtttatttctgctttcatcattatttctttccttctactaattttggatttggcttgttcttgcttttctagtttcttgagatacattgctacgttgctrattggaaatccttctactttttggatgtaggcatctattgctatacattttcctcttaacacttcttttgctgtataccataggtttttgatatgctgtatgtctattttcatttctttcaagacatttaacattttccttcttaatttctttattgacccattgaccattcaggaacgtgtttaacttccatttccatgtgtttgtaaaatttcaaaagttcctcttgttattgatttcattgtggtcaggaaagatatttgagatcattgcagtttggtggttttctgcagtaacaag

SEQ ID NO: 8857 - DNA, 601 bp, Human
taattggtctattcaggttttctatttcttcttggttcaatcatggcacattgcatgtatacatgaatttatccatttccactagattttctaatttgttggcatatagttgttcataatagtctctcatgatcacttgtatttctatggtatcagttgcaatgtctccttttttgttggtgattttatgtggaccatttacattcttgattcatctagctaattatttgtcagttttgttaatcgtttcaaaaaccaacttttaatttcatcgatcttttgtattattttttagcgtgartttttttattttattattattattattttattattattatactttaagttttagggtacatgtgcacaatgtgcaggttagttacatatgtatacatgtgccatgctgttgtgctgcacccattaactcgtcatttagcattaggtatatctcctaatgctatcctcccccctccccccaccccacaacactccccagagtgtgatgttccccttcctgtgtccatgtgttctcattgttcaattcccacctatgagtgagaacatgcggtgtttggttttttgtccttgcgatagttta

SEQ ID NO: 8858 - DNA, 601 bp, Human
aatttttattagttctttaaatgttttgtagaattctgcaatgaagtcatcaggtcctgggcttctcttcaatgggagactttttattacaagattcaatctcattacttataattggtctattcaggttttctatttcttcttggttcaatcatggcacattgcatgtatacatgaatttatccatttccactagattttctaatttgttggcatatagttgttcataatagtctctcatgatcacttgtatttctatggtatcagttgcaatgtctccttttttgttggtgattttatktggaccatttacattcttgattcatctagctaattatttgtcagttttgttaatcgtttcaaaaaccaacttttaatttcatcgatcttttgtattattttttagcgtgaatttttttattttattattattattattttattattattatactttaagttttagggtacatgtgcacaatgtgcaggttagttacatatgtatacatgtgccatgctgttgtgctgcacccattaactcgtcatttagcattaggtatatctcctaatgctatcctcccccctccccccaccccacaac

SEQ ID NO: 8859 - DNA, 601 bp, Human
tggcctcccaaagccctgagattacaggcatgagacaccacacctggctgtgaacgatctttttaatgtgttgctggattcagtttgctagcattttgttgaggctttgtgtgtctatgttcattggggatactggcctaaagttttcttttcttgttgtatctctgtctagttttggtatcaacataatgctggtcttgtggaataagtttagaagaattccctcctcttcaattttctggaagagtttgagaagaatttttattagttctttaaatgttttgtagaattctgcaatgargtcatcaggtcctgggcttctcttcaatgggagactttttattacaagattcaatctcattacttataattggtctattcaggttttctatttcttcttggttcaatcatggcacattgcatgtatacatgaatttatccatttccactagattttctaatttgttggcatatagttgttcataatagtctctcatgatcacttgtatttctatggtatcagttgcaatgtctccttttttgttggtgattttatgtggaccatttacattcttgattcatctagctaattatttgtcag

SEQ ID NO: 8860 - DNA, 601 bp, Human
ctgttgatgtaatgtgtcatgtttatggatttgtatatgttgaaccattcttgcaactttgggataaatcccacttgataatggtgaatgatcttttaaatttatttttattttttgagatggggtctcattttgttgcccagactggagtacagtggcttgatcatggctcattgcagtctcaatctcccagactcaagcaatcctcccacctcagcctccctagtacctgggctataggagcatgccaccatgcctggctaatttttaaattttttgcagaaatgggatctccctctgytgcccaggctggtcttgaactcctaggttcaagtgatcctcctgccttggcctcccaaagccctgagattacaggcatgagacaccacacctggctgtgaacgatctttttaatgtgttgctggattcagtttgctagcattttgttgaggctttgtgtgtctatgttcattggggatactggcctaaagttttcttttcttgttgtatctctgtctagttttggtatcaacataatgctggtcttgtggaataagtttagaagaattccctcctcttcaattttctggaagagtttgag

SEQ ID NO: 8861 - DNA, 601 bp, Human
cattctgttgatgtaatgtgtcatgtttatggatttgtatatgttgaaccattcttgcaactttgggataaatcccacttgataatggtgaatgatcttttaaatttatttttattttttgagatggggtctcattttgttgcccagactggagtacagtggcttgatcatggctcattgcagtctcaatctcccagactcaagcaatcctcccacctcagcctccctagtacctgggctataggagcatgccaccatgcctggctaatttttaaattttttgcagaaatgggatctcccwctgttgcccaggctggtcttgaactcctaggttcaagtgatcctcctgccttggcctcccaaagccctgagattacaggcatgagacaccacacctggctgtgaacgatctttttaatgtgttgctggattcagtttgctagcattttgttgaggctttgtgtgtctatgttcattggggatactggcctaaagttttcttttcttgttgtatctctgtctagttttggtatcaacataatgctggtcttgtggaataagtttagaagaattccctcctcttcaattttctggaagagtt

SEQ ID NO: 8862 - DNA, 601 bp, Human
gatgttaggggaaaggctgtcaactttttcccattcagtgcgatgtttgctatgggcttatgatatatggcctttatcgtgttgagctgtggtccttctataactaattagttgagtgttttgattatgaagcgatgttgaattgtatcaaatcctttttatgtatctattgagatggtcatgtggtttttatacttcattctgttgatgtaatgtgtcatgtttatggatttgtatatgttgaaccattcttgcaactttgggataaatcccacttgataatggtgaatgatcttttaamtttatttttattttttgagatggggtctcattttgttgcccagactggagtacagtggcttgatcatggctcattgcagtctcaatctcccagactcaagcaatcctcccacctcagcctccctagtacctgggctataggagcatgccaccatgcctggctaatttttaaattttttgcagaaatgggatctccctctgttgcccaggctggtcttgaactcctaggttcaagtgatcctcctgccttggcctcccaaagccctgagattacaggcatgagacaccacacctggctgtg

SEQ ID NO: 8863 - DNA, 601 bp, Human
aaatgctactgatttctgtatgttgattctgtatcctgcaactttactgaatttgtttatcagttgtaagagttttttggtagagcttttagggttttctgtatatatgatgatatcatctgcaaatagggacaatttgacatcctcctttccattttggaggtcctttatttctttctattgcctgattgctctggctaggacttccattactctgttgaacaaaagtggtaaaagtgagcatcgttgtcttgtttcagatgttaggggaaaggctgtcaactttttcccattcagtgcratgtttgctatgggcttatgatatatggcctttatcgtgttgagctgtggtccttctataactaattagttgagtgttttgattatgaagcgatgttgaattgtatcaaatcctttttatgtatctattgagatggtcatgtggtttttatacttcattctgttgatgtaatgtgtcatgtttatggatttgtatatgttgaaccattcttgcaactttgggataaatcccacttgataatggtgaatgatcttttaaatttatttttattttttgagatggggtctcattttgttgccc

SEQ ID NO: 8864 - DNA, 601 bp, Human
tgcttttggtagtaagatcattttcacaatatttattcttcaaatctatgaatatgagatatcttttcattttttgtgtgttctcttctgctagcttgttgctggcatatagaaatgctactgatttctgtatgttgattctgtatcctgcaactttactgaatttgtttatcagttgtaagagttttttggtagagcttttagggttttctgtatatatgatgatatcatctgcaaatagggacaatttgacatcctcctttccattttggaggtcctttatttctttctattgcctgaytgctctggctaggacttccattactctgttgaacaaaagtggtaaaagtgagcatcgttgtcttgtttcagatgttaggggaaaggctgtcaactttttcccattcagtgcgatgtttgctatgggcttatgatatatggcctttatcgtgttgagctgtggtccttctataactaattagttgagtgttttgattatgaagcgatgttgaattgtatcaaatcctttttatgtatctattgagatggtcatgtggtttttatacttcattctgttgatgtaatgtgtcatgtttatgga

SEQ ID NO: 8865 - DNA, 601 bp, Human
aaatgttcttggtgcctttgtcaaggatcagtaggctatacatacacgaatttatttctaggttctctattttgttccattggtatatgaatctgtattttacacaagtaacatgctgtattggttactatacctttatagtatcttttgaaacctggcagtgtgatgcctccaactttgttcttttcattcaggattgctttggctatagggtcttttgtgggtgcatgtaaattttaggattttttaatttctgttgagaatgttattggtatttagatagggattgcattgactctgyagattgcttttggtagtaagatcattttcacaatatttattcttcaaatctatgaatatgagatatcttttcattttttgtgtgttctcttctgctagcttgttgctggcatatagaaatgctactgatttctgtatgttgattctgtatcctgcaactttactgaatttgtttatcagttgtaagagttttttggtagagcttttagggttttctgtatatatgatgatatcatctgcaaatagggacaatttgacatcctcctttccattttggaggtcctttatttctttctattgc

SEQ ID NO: 8866 - DNA, 601 bp, Human
tgatataatcccatttgtctatttttgcttttgttgcctgtgcctttgaggtcttctccataaaatctttgcccagaccaatgttctgaagcatttctcctatgttttctttcaggagtttcatagcttcaggtcttatatttaagtcattaacccattttgagttgatttttatatatggtgagagatacaggtttggtttcatttttatgcatgtggatatccaattttcccagcaccatttattgaaaagactgtctcttcctcaataaatgttcttggtgcctttgtcaaggatcaktaggctatacatacacgaatttatttctaggttctctattttgttccattggtatatgaatctgtattttacacaagtaacatgctgtattggttactatacctttatagtatcttttgaaacctggcagtgtgatgcctccaactttgttcttttcattcaggattgctttggctatagggtcttttgtgggtgcatgtaaattttaggattttttaatttctgttgagaatgttattggtatttagatagggattgcattgactctgtagattgcttttggtagtaagatcattttca

SEQ ID NO: 8867 - DNA, 601 bp, Human
tccattaactaacctttggctattctcctctcccctacccttcccacccctcaggaaaaacactactctactctttgcttctatgagatcaacgttttttagcttccatgtatgagaacatgtggtatttatctttctgtgcctggcttatttcacttaacatagtgaccttcagtttcatccatgttactgtgaatgacaggatttcattttgttttatggctaaagagtattccattgtgtatatataccatattttcttcattcacccactgatggacccttaagttgattctatatmttgggtattgtgaatagtactgcaataaatatgggagtgcacatatctccttgatatactgatttcatttcctttgcatatatacccagtagcgggattgctggatcatatggtagttctatttttagttttttgaggagccttcatattgttttccacaatggctagactaatttgcattctcaccagtggtggataagagtacccctttctctacaacctcgccaggatctgttattttttaactttttgataatggccattctaaccgggttgagatcatatctcatcgtggtttta

SEQ ID NO: 8868 - DNA, 601 bp, Human
gtagagatccaacttcattatcttctttttttattatgtttaattgacatataaatatacatatttatgggctagagtatatttcaatatatgtgtacaatgtgtaatgataagtcagtgtaattagcataaccatcacctcaaatatttatcatttctctgtgttgggaacattcaaaattcactcttgtaacttttcaaaaatatacaataaattgttgttaatgatagtcaccctatagtgctatagagcactagaccttattcctcctatttaattgtacttttatatccattaacyaacctttggctattctcctctcccctacccttcccacccctcaggaaaaacactactctactctttgcttctatgagatcaacgttttttagcttccatgtatgagaacatgtggtatttatctttctgtgcctggcttatttcacttaacatagtgaccttcagtttcatccatgttactgtgaatgacaggatttcattttgttttatggctaaagagtattccattgtgtatatataccatattttcttcattcacccactgatggacccttaagttgattctatatcttgggtatt

SEQ ID NO: 8869 - DNA, 601 bp, Human
tcaaagaaagggaagttcagtaaatacccatatgttttcagcattaaagaccctcttaagaacccacaaattcttggccacttaaatttgagtagtctccaataatcacatgaaagatccctctcttggatttagaaggaaaatgcctggtgtgtggtgagttttctgtttttgtttttgtttttttcccttttttttttttttagagaaaacgttttccattgttgtctcactgccatcccttcctcactcctctggaaatttttgatatcaataatctccactttcttatgcatgttcmtctatccttctgttaaaaacaaaataagaaaattttattaaccatcttatttgccattaggtatcttgttttttgcagtactcattctcaaactttgctgtacattagaattacctgggaagcttttaaatcccagatgcacaggctgcatctcatacccgtaagatcactggcggtggaacccaagcattggtacttttggactctccagatgattccaatgtgcagccaagcatgggaaccgctgctcctaagcagtgcttcccaaaccttaatgtacatatgaatcatctggggagc

SEQ ID NO: 8870 - DNA, 601 bp, Human
cactgtctactgaggagttaaaatttccccagaccgaagaagctggacatgggtacacagcttgggaagaaatgttcaccaccatattaataaactttctctttataaattcaaagaaagggaagttcagtaaatacccatatgttttcagcattaaagaccctcttaagaacccacaaattcttggccacttaaatttgagtagtctccaataatcacatgaaagatccctctcttggatttagaaggaaaatgcctggtgtgtggtgagttttctgtttttgtttttgtttttttcccttttttttttttttagagaaaacgttttccattgttgtctcactgccatcccttcctcactcctctggaaatttttgatatcaataatctccactttcttatgcatgttcatctatccttctgttaaaaacaaaataagaaaattttattaaccatcttatttgccattaggtatcttgttttttgcagtactcattctcaaactttgctgtacattagaattacctgggaagcttttaaatcccagatgcacaggctgcatctcatacccgtaagatcactggcggtggaacccaagcat

SEQ ID NO: 8871 - DNA, 601 bp, Human
tgcgcagggcccactgtctactgaggagttaaaatttccccagaccgaagaagctggacatgggtacacagcttgggaagaaatgttcaccaccatattaataaactttctctttataaattcaaagaaagggaagttcagtaaatacccatatgttttcagcattaaagaccctcttaagaacccacaaattcttggccacttaaatttgagtagtctccaataatcacatgaaagatccctctcttggatttagaaggaaaatgcctggtgtgtggtgagttttctgtttttgtttttktttttttcccttttttttttttttagagaaaacgttttccattgttgtctcactgccatcccttcctcactcctctggaaatttttgatatcaataatctccactttcttatgcatgttcatctatccttctgttaaaaacaaaataagaaaattttattaaccatcttatttgccattaggtatcttgttttttgcagtactcattctcaaactttgctgtacattagaattacctgggaagcttttaaatcccagatgcacaggctgcatctcatacccgtaagatcactggcggtgg

SEQ ID NO: 8872 - DNA, 601 bp, Human
agattcaagtaattataccctccaccaccacacacacacacacacacacatcaacttaagaaggcacagaaactgcatggttaatttcagtgcagacaagggtacagtgtactgatactgcaaccaagaaggtgggttcaagtcacctggagaagacaatctgggggcatgggacagaaacggagcttgtcggaaggaggggaaggggtgggtgatgagaagtctcaaagctaactctgcaagcctcataattttgcctaggagatatttcagagtcataattttgaaaagaccagtaaayggcagagacaatggtcattagagagacatggccgattgctggggaggagaatcctcagggctgaatgccatatataggaagagcatgccccagaccctgcgcagggcccactgtctactgaggagttaaaatttccccagaccgaagaagctggacatgggtacacagcttgggaagaaatgttcaccaccatattaataaactttctctttataaattcaaagaaagggaagttcagtaaatacccatatgttttcagcattaaagaccctcttaagaacccacaaattcttggccact

SEQ ID NO: 8873 - DNA, 601 bp, Human
gccaggaactacggtttgatcccagaagctctgaatggaagtagaaatgatatgtaaagaaaatggtaaatatgagaaaatctaaatagaatgatgatgatgtctaatttgtgggcttaaaaccaaacaagtatgccaggtacaatggctcacgcctataatcccagcactttgggaggctgagatgggaggatcccttgaggccagccaggagtttgagacaagcttaggcaacatactgagacctggtctgtactactactactactactactactactactactactactactactamtaataataataataataatttgagcatggtggtgcatgcctgtagtcccagcaacacaggaggctgaggcaagaggatcccttgagcccaggagttcaaggctgtagtgagctatgatcacaccactgcactccagcctagatgacaaagtgagactctgtcttaaaacaaacaaacaaataaaaccaagcaaacagagttaaaatcctggaaaataatagcaagcaaggaaaggaaatcaaatgaaagcattttaaagtatttatattgtttggaagtggggtaaagctactgattaaa

SEQ ID NO: 8874 - DNA, 601 bp, Human
acacttaactgcctgaatatcctggagactatcaaccagtccaaaatgccaggaactacggtttgatcccagaagctctgaatggaagtagaaatgatatgtaaagaaaatggtaaatatgagaaaatctaaatagaatgatgatgatgtctaatttgtgggcttaaaaccaaacaagtatgccaggtacaatggctcacgcctataatcccagcactttgggaggctgagatgggaggatcccttgaggccagccaggagtttgagacaagcttaggcaacatactgagacctggtctgtactactactactactactactactactactactactactactactaataataataataataataatttgagcatggtggtgcatgcctgtagtcccagcaacacaggaggctgaggcaagaggatcccttgagcccaggagttcaaggctgtagtgagctatgatcacaccactgcactccagcctagatgacaaagtgagactctgtcttaaaacaaacaaacaaataaaaccaagcaaacagagttaaaatcctggaaaataatagcaagcaaggaaaggaaatcaaatgaaagcatt

SEQ ID NO: 8875 - DNA, 601 bp, Human
gctccttaaattgagcatatttaactttggtattctatcagatgtcattgtccccctctactccataaatcacagtgatcagagacagtggaagagaaacattcaggggtgcccacggtcctgggacagcagcggcagcactgcaggggtgggggtggggcatatttcccaggacctttcttttctcattttctttcggagacacttaactgcctgaatatcctggagactatcaaccagtccaaaatgccaggaactacggtttgatcccagaagctctgaatggaagtagaaatgataygtaaagaaaatggtaaatatgagaaaatctaaatagaatgatgatgatgtctaatttgtgggcttaaaaccaaacaagtatgccaggtacaatggctcacgcctataatcccagcactttgggaggctgagatgggaggatcccttgaggccagccaggagtttgagacaagcttaggcaacatactgagacctggtctgtactactactactactactactactactactactactactactactaataataataataataataatttgagcatggtggtgcatgcctgtagtcccagc

SEQ ID NO: 8876 - DNA, 601 bp, Human
caggattcatacataatataaataatcaataaggctcctgacgtaaccaagacatggtttcaggtgtcccagtgtccacacgccaaactcacagttagctgttgatagcagtggtttgggatttcaatgcccaatacaatttcaaaaaatctgggttgtgattcacaactttgtatttgccaagtaaggaaatataaaaacaaatcttaatgaattaatttaaaacaaaacaaaataacaaacttcaactaccatcaccattattttataaaataaacagcaaaaaaggtaggaaagacasgatctctgaataaataacagctccttaaattgagcatatttaactttggtattctatcagatgtcattgtccccctctactccataaatcacagtgatcagagacagtggaagagaaacattcaggggtgcccacggtcctgggacagcagcggcagcactgcaggggtgggggtggggcatatttcccaggacctttcttttctcattttctttcggagacacttaactgcctgaatatcctggagactatcaaccagtccaaaatgccaggaactacggtttgatcccagaagctctg

SEQ ID NO: 8877 - DNA, 601 bp, Human
atgtatgtagggagcacaataggcacccaggtcattttgctagtgtagactcagccttacagaagtagctaaaaacaatttaaatcattgagggtgtactgaggactccctgataatctaatacagttcagctaagtactaaaggttgcaaagtactgttaacaccacaggattcatacataatataaataatcaataaggctcctgacgtaaccaagacatggtttcaggtgtcccagtgtccacacgccaaactcacagttagctgttgatagcagtggtttgggatttcaatgcccartacaatttcaaaaaatctgggttgtgattcacaactttgtatttgccaagtaaggaaatataaaaacaaatcttaatgaattaatttaaaacaaaacaaaataacaaacttcaactaccatcaccattattttataaaataaacagcaaaaaaggtaggaaagacaggatctctgaataaataacagctccttaaattgagcatatttaactttggtattctatcagatgtcattgtccccctctactccataaatcacagtgatcagagacagtggaagagaaacattcaggggtgccc

SEQ ID NO: 8878 - DNA, 601 bp, Human
atgatgaaggtacatagtaagttattggtagaatattgggttgtgtgactctcaaagcagtgttcttaagaaattgggagcataaacatcaccagatgtatgtagggagcacaataggcacccaggtcattttgctagtgtagactcagccttacagaagtagctaaaaacaatttaaatcattgagggtgtactgaggactccctgataatctaatacagttcagctaagtactaaaggttgcaaagtactgttaacaccacaggattcatacataatataaataatcaataaggctccygacgtaaccaagacatggtttcaggtgtcccagtgtccacacgccaaactcacagttagctgttgatagcagtggtttgggatttcaatgcccaatacaatttcaaaaaatctgggttgtgattcacaactttgtatttgccaagtaaggaaatataaaaacaaatcttaatgaattaatttaaaacaaaacaaaataacaaacttcaactaccatcaccattattttataaaataaacagcaaaaaaggtaggaaagacaggatctctgaataaataacagctccttaaattgagcata

SEQ ID NO: 8879 - DNA, 601 bp, Human
attcacctttcttatttcataagctggtgttgctttcacagcacactgccctctgagatgagcgggagatatgtcccgaagaactgtttacctttatagcaactcaggaaaaaagagaaagctaggctagagacacactaggtaatcaaaccatcttggtgggccaattagatttaatctagtagcaatgcactggtactcacacggtgaagagtccacgaagttcgggtcaatattatgcagcagctcaattctgggggatgggcttccttcactggaaaacaatttttaagggaatgtkaatttcctctctctaatgggcatgaattattttaatacttcccttccttgtacttataggaaataacaaacctgccagttaacaactctgtcatgaatttggaggtctccacaatcacggctggtgcatcttcaagcagtcatcgtttgtttacattgaccgaaccctttacataagaacttcagtgtcaagcatatgaagatattttaaaaaatgattctgggaccctttgaaataaatattgtggccttatttaaacatgaccattttttacaccagagaaatgagaactcaagtcac

SEQ ID NO: 8880 - DNA, 601 bp, Human
ttttgtaaatggggaaggctggggcagggagagttcaatggcttaaaggctagtaagcggcagagcaagaatagaattcacctttcttatttcataagctggtgttgctttcacagcacactgccctctgagatgagcgggagatatgtcccgaagaactgtttacctttatagcaactcaggaaaaaagagaaagctaggctagagacacactaggtaatcaaaccatcttggtgggccaattagatttaatctagtagcaatgcactggtactcacacggtgaagagtccacgaagttygggtcaatattatgcagcagctcaattctgggggatgggcttccttcactggaaaacaatttttaagggaatgttaatttcctctctctaatgggcatgaattattttaatacttcccttccttgtacttataggaaataacaaacctgccagttaacaactctgtcatgaatttggaggtctccacaatcacggctggtgcatcttcaagcagtcatcgtttgtttacattgaccgaaccctttacataagaacttcagtgtcaagcatatgaagatattttaaaaaatgattctggga

SEQ ID NO: 8881 - DNA, 601 bp, Human
gtgggcagcagtatgtccagaaaggagcggatgggagcccccatgtgaataagggaatataagggcactgtttgcaagatgagcattatgatgaaagctgggcaaagggtctaattgctaaggctttctatgcccaaactcactatgctgagggcattagggccactcgcatggtatttatacaggcctattacagtccgttgtgatctggaagcactacatgcatgcctgccctgaaggaaatggtaaggctctttacaggttaatttaggcaggaggcagaatcaagcggaatcacttccaggactgctaggaaagtcacacttgtgacacccagcaggtgttgggcagtacctgaccagcccaatcagataatgtggttgctcacactacctggaacccaactgtggcttatctgactgtgagttttctggaaggtggctctggagctctcaggtaagaacagggcagcaacatgacatctacagtgagaaggagcctcagagatgccatgagttcttcttttgtaaatggggaaggctggggcagggagagttcaatggcttaaaggctagtaagcggcagagcaagaatagaattc

SEQ ID NO: 8882 - DNA, 601 bp, Human
ttctattagccacattaagaaaggaagaggagagaagtaaaacactaacaatatatttaattcaatatatccaaagtattatcctttcaacaaataataaatctataatattgtatgcatataatacataggtgtactaagtcttgaaaatcggatgtatatattctactcacagcacatctcaatccacagttagccatattttaagtacctgacagccacatgtggcctgtggctactatactggacagcacaaatctagactgttcttacagtccttagggctcaaaccttgcccttrcctctctcactgacatgcgtttactccaaaagaaatagaaatttctccacgatgtagccattctcgcctgtctcagggccctttcctgtccaggtcttaatgtgtccacttggtctttattgcatctcaactctccaattgtccactgagtcatcaagtaatcattactgagtgcctagcaagctcccagtatttgtgttaactgacaaggataaaaaaatacaggagatgctgacttccaggagctctcagcttggaaatgcaggcacaaacacgaacatgtgagggatgctatacgga

SEQ ID NO: 8883 - DNA, 601 bp, Human
tcacctcccgccgggcccctcctccagcatgggggattacaattcgacatgacacttgggtgggacacaaatcccaaccatatcacataggagtatagttctcaagctcctacttcaaatgccaaaccaaaatacagcttagtgagtgaggggtcttaaggtttttcatttgtaggtggaatttagcaggtgaagacatttacaaccattataatgtgggtggcatattccacatatcccctagacctaggttatactgggctttgcagtgcattaaattactcagaaagttttaaagccrttcctgcctccccactattctcttccagccacccttagagactttgatatgactgaaatgtatctcttaggtgtactggggtagagaaaagtttaggagtcattgatgtagcctcacagtaactattcacagctctgtgatcagctcagctgatcaacttacttcctagcaccttctagaaggggtttttaggccaatagaaatataatgcaagtcacttatgtaagttaattaaaattaaattttctattagccacattaagaaaggaagaggagagaagtaaaacactaacaatatat

SEQ ID NO: 8884 - DNA, 601 bp, Human
aaatcagaaaggtggccaggatatagtaataagaaactcataaaataattcaaattcctctagtgcatataatgtttctagcatttgcacttgtgtttatctatttatgatcatgcctttggcaacatcactgcttatcaatggacacactccttctagcaggcagaaaaaggagagaagcagagtaagcagatttgctcctttgaggtcccattcatatagagacccacagaacactgaagccagagggaccttggagatcatttaattccttctttactccacaggtgaggaaactgaygaagtggctttagggaaggtggaggtggaacgctaccttcttctcccgcagtaagcaccaacgatctgggaagagctggagtgagaaaccacagaaatgcttctgtgataacactgactccattgttaaccctcagtttacacccgagattggctacttctgatttaactccacaaaagcctctgtgctctatgaatatgatatccagacttggctgtcccctaagtacatgtttttttatagctggatttaatttttcctcataaatgaattgcatagaaaaggaaacgggcttgtatc

SEQ ID NO: 8885 - DNA, 601 bp, Human
tcgtatgattcacaatcagaggagacattggtcaacaaaccccaggatgacccactaagggaaagaggagatagaaaagcggatcgatacggtgatgtttcggaacggaaatcagaaaggtggccaggatatagtaataagaaactcataaaataattcaaattcctctagtgcatataatgtttctagcatttgcacttgtgtttatctatttatgatcatgcctttggcaacatcactgcttatcaatggacacactccttctagcaggcagaaaaaggagagaagcagagtaagcagmtttgctcctttgaggtcccattcatatagagacccacagaacactgaagccagagggaccttggagatcatttaattccttctttactccacaggtgaggaaactgacgaagtggctttagggaaggtggaggtggaacgctaccttcttctcccgcagtaagcaccaacgatctgggaagagctggagtgagaaaccacagaaatgcttctgtgataacactgactccattgttaaccctcagtttacacccgagattggctacttctgatttaactccacaaaagcctctgtgctcta

SEQ ID NO: 8886 - DNA, 601 bp, Human
acaacctaccatgtgcatgtgaccatgaaaaaaatcctgactccaccagcaggatgggcctctgggcaccctataatttgactaggggaatggggtgtgtgttggcagggagcgggggaggtgtagctgctgaaatccaagaggccagcttctgggagcatgtggtgctaggcagagggcagaaatctcctgggaagtgcgtaatgcctattcgtatgattcacaatcagaggagacattggtcaacaaaccccaggatgacccactaagggaaagaggagatagaaaagcggatcgatayggtgatgtttcggaacggaaatcagaaaggtggccaggatatagtaataagaaactcataaaataattcaaattcctctagtgcatataatgtttctagcatttgcacttgtgtttatctatttatgatcatgcctttggcaacatcactgcttatcaatggacacactccttctagcaggcagaaaaaggagagaagcagagtaagcagatttgctcctttgaggtcccattcatatagagacccacagaacactgaagccagagggaccttggagatcatttaattccttctttactc

SEQ ID NO: 8887 - DNA, 601 bp, Human
tgagtaatcacacaatgttattgtccatagaggctacattattttactttcccattaacagtgaataagggttccaatttctctacatcctcaacaattcttattttcccctccctccctccctcccttccttcctttttccactctctctccttttctttctttcattttttaaattgtagtcatcctaatggtataatttacgtatgcatccttgagactttatgctttactgcagaatggtgaatctcctgatctatgagagatttggtgacccctggtgtgtgtgcatgtttctctrtgaatgtgtacgtgtatcaatattttgtgccgatctttgagtatttttactgttagtatccaagccacaacctaccatgtgcatgtgaccatgaaaaaaatcctgactccaccagcaggatgggcctctgggcaccctataatttgactaggggaatggggtgtgtgttggcagggagcgggggaggtgtagctgctgaaatccaagaggccagcttctgggagcatgtggtgctaggcagagggcagaaatctcctgggaagtgcgtaatgcctattcgtatgattcacaatcagagga

SEQ ID NO: 8888 - DNA, 601 bp, Human
ggaggtacttttaggctcaggaaaggctgtaagacaataaaacaatgactttgacaggttgatctgtttatcattcattagcagatatttactgatattaacccaacaacttactacgatgttaggttctgtgctacggagaccttactgtgcatatggcagtaaatgaaaaagatagagaccctattctcatgcagtttctcttcagttttggaaggagggaaagttacgttttatttattttttatatttttaaattgtggtaaaatacaaacaacataaaatttactatcctaaccayttttaattgtatggtccagtggcattaaatacattcacgttgttatgctgtcatcatcaccatccatctctacacccactcaacaatcatgccccattctcccctccccacaacctcaggcaaccaccattctattttctgtccctatgaatctgaccactttaggtacctcatgtaagtggagtcatatagtttttccttttgtgacttgcttagcataatgtctttaaggttcatccatgttgtagcatgtattagaatttctttctctgttagtgctggatactatttcatggtata

SEQ ID NO: 8889 - DNA, 601 bp, Human
gccatctggaggtacttttaggctcaggaaaggctgtaagacaataaaacaatgactttgacaggttgatctgtttatcattcattagcagatatttactgatattaacccaacaacttactacgatgttaggttctgtgctacggagaccttactgtgcatatggcagtaaatgaaaaagatagagaccctattctcatgcagtttctcttcagttttggaaggagggaaagttacgttttatttattttttatatttttaaattgtggtaaaatacaaacaacataaaatttactatcytaaccacttttaattgtatggtccagtggcattaaatacattcacgttgttatgctgtcatcatcaccatccatctctacacccactcaacaatcatgccccattctcccctccccacaacctcaggcaaccaccattctattttctgtccctatgaatctgaccactttaggtacctcatgtaagtggagtcatatagtttttccttttgtgacttgcttagcataatgtctttaaggttcatccatgttgtagcatgtattagaatttctttctctgttagtgctggatactatttca

SEQ ID NO: 8890 - DNA, 601 bp, Human
agcttctaagttatttttacttaggcacaaaaggtaggtttggggtttaaaaggagtataagtggccatctggaggtacttttaggctcaggaaaggctgtaagacaataaaacaatgactttgacaggttgatctgtttatcattcattagcagatatttactgatattaacccaacaacttactacgatgttaggttctgtgctacggagaccttactgtgcatatggcagtaaatgaaaaagatagagaccctattctcatgcagtttctcttcagttttggaaggagggaaagttaygttttatttattttttatatttttaaattgtggtaaaatacaaacaacataaaatttactatcctaaccacttttaattgtatggtccagtggcattaaatacattcacgttgttatgctgtcatcatcaccatccatctctacacccactcaacaatcatgccccattctcccctccccacaacctcaggcaaccaccattctattttctgtccctatgaatctgaccactttaggtacctcatgtaagtggagtcatatagtttttccttttgtgacttgcttagcataatgtcttta

SEQ ID NO: 8891 - DNA, 601 bp, Human
tttctggccgatcttttcaatgcagggagcgatgagggtgggcacttagaagctgaatgaacagtttcaaacatctgtatataatgtcaattacaacttaataagtgacttgtagcttctaagttatttttacttaggcacaaaaggtaggtttggggtttaaaaggagtataagtggccatctggaggtacttttaggctcaggaaaggctgtaagacaataaaacaatgactttgacaggttgatctgtttatcattcattagcagatatttactgatattaacccaacaacttactaygatgttaggttctgtgctacggagaccttactgtgcatatggcagtaaatgaaaaagatagagaccctattctcatgcagtttctcttcagttttggaaggagggaaagttacgttttatttattttttatatttttaaattgtggtaaaatacaaacaacataaaatttactatcctaaccacttttaattgtatggtccagtggcattaaatacattcacgttgttatgctgtcatcatcaccatccatctctacacccactcaacaatcatgccccattctcccctccccacaacct

SEQ ID NO: 8892 - DNA, 601 bp, Human
gcagagccccagactcagagggaagtcaggccgagccaggccagaggcaaaggctttataaatctctatttgtctattgaggaggtctgggaaaagggatgaagttgggcagggaaatcccacatcatcttttctggccgatcttttcaatgcagggagcgatgagggtgggcacttagaagctgaatgaacagtttcaaacatctgtatataatgtcaattacaacttaataagtgacttgtagcttctaagttatttttacttaggcacaaaaggtaggtttggggtttaaaaggagtrtaagtggccatctggaggtacttttaggctcaggaaaggctgtaagacaataaaacaatgactttgacaggttgatctgtttatcattcattagcagatatttactgatattaacccaacaacttactacgatgttaggttctgtgctacggagaccttactgtgcatatggcagtaaatgaaaaagatagagaccctattctcatgcagtttctcttcagttttggaaggagggaaagttacgttttatttattttttatatttttaaattgtggtaaaatacaaacaacataaaattt

SEQ ID NO: 8893 - DNA, 601 bp, Human
aggagcagaaccgaactcagaacagcaagaagaggcagagccccagactcagagggaagtcaggccgagccaggccagaggcaaaggctttataaatctctatttgtctattgaggaggtctgggaaaagggatgaagttgggcagggaaatcccacatcatcttttctggccgatcttttcaatgcagggagcgatgagggtgggcacttagaagctgaatgaacagtttcaaacatctgtatataatgtcaattacaacttaataagtgacttgtagcttctaagttatttttacttargcacaaaaggtaggtttggggtttaaaaggagtataagtggccatctggaggtacttttaggctcaggaaaggctgtaagacaataaaacaatgactttgacaggttgatctgtttatcattcattagcagatatttactgatattaacccaacaacttactacgatgttaggttctgtgctacggagaccttactgtgcatatggcagtaaatgaaaaagatagagaccctattctcatgcagtttctcttcagttttggaaggagggaaagttacgttttatttattttttatatttt

SEQ ID NO: 8894 - DNA, 601 bp, Human
ctgttctttcaccctataatcaggagcagaaataacatctcattagaaactttaaagagaagagggcctttaaatgaaatagtaacaaagctgtatggaatcactttgaagagctggcctttggtggggtggaaaatgctaacatctgtcactgcccttcatctataatcaagcttctaccagcagaatgtgtgtgtctcctgtgtgtgcgtacgttttaaatatatacacctatgttacatgatcggatatgtgtgttccagccatcatagaatgccacgtctgacttccaaagtgagtygtggtctcagatggggcaggatcattactgcagaacagccaagatcaagcccggcacctgcaggataggtgtatatgtttttcctcaggcaaaataatgcctttgaagcagttctccttgtggtctgagccatgcttgctggggccttgcaggagtgtggaatttggggctggagctctccttggaaccatgtagagctgaattcagacctgcaggacctcttgcctaccctgggattatggctgttccccaccactttagaggtttccaggctttcccactaatcagcttcaatggtgc

SEQ ID NO: 8895 - DNA, 601 bp, Human
gactcaagttcaaaagaatcagagagggcttcacggaggagtaggaatgtgcactgaactctacagaaggcgcagggcaacaagggagataaacaggactgaaggagggcattgcaatggtgctgaatggtgggcgttgtaggagggcttgctagtggacagctgggaaccaccaacagccttccagcagggtggggagaggctgtgtccatgccctcttccagactcttccagactgggttttagccagacctttaggtttggctttagcttaactgatctcgagtatttataacagtayctcatgcatcccaggccatcatcgtttatttatttactgaataaacaatcttggaaatggcaacataatactgggaaatggctctgaatgtcgctctgaggaggaaacagggagcagctccaagcattccaacctggacgactcttggatctcaagcatggatttggcaattgcaccacagaaaatgtgtgtgtgagagaggagagggtgggaagaaggctgttctttcaccctataatcaggagcagaaataacatctcattagaaactttaaagagaagagggcctttaaatgaaata

SEQ ID NO: 8896 - DNA, 601 bp, Human
tattagcatgcattctttcaatatgtattaatctcttatacataagacaccgagagaactatacaatgaagccttgctctccttatagctccggatggggaaaacacgtgaatataaatactgcactatgaggcagcaagagctcaccgtcctgggaagctccagagaaactcaagggactcaagttcaaaagaatcagagagggcttcacggaggagtaggaatgtgcactgaactctacagaaggcgcagggcaacaagggagataaacaggactgaaggagggcattgcaatggtgcygaatggtgggcgttgtaggagggcttgctagtggacagctgggaaccaccaacagccttccagcagggtggggagaggctgtgtccatgccctcttccagactcttccagactgggttttagccagacctttaggtttggctttagcttaactgatctcgagtatttataacagtacctcatgcatcccaggccatcatcgtttatttatttactgaataaacaatcttggaaatggcaacataatactgggaaatggctctgaatgtcgctctgaggaggaaacagggagcagctccaa

SEQ ID NO: 8897 - DNA, 601 bp, Human
gcctcagtttcttcacttggattataaagagtgaacaaactgccaaggggcccttagcctctggcattctatgcaatgctgagcaatctgtagcagggtgagccccatgcattccccctaactcttgattctgcttaatatctaatttcaggctgaaagaaagatgcctctgtgtcactacttctctaatagacccaaaaagaaataaaaatgccttgaaaatgatgtatgaaattactattgttctcattagactgattctaatcgaatcagctgatgataaattattcatttattagcrtgcattctttcaatatgtattaatctcttatacataagacaccgagagaactatacaatgaagccttgctctccttatagctccggatggggaaaacacgtgaatataaatactgcactatgaggcagcaagagctcaccgtcctgggaagctccagagaaactcaagggactcaagttcaaaagaatcagagagggcttcacggaggagtaggaatgtgcactgaactctacagaaggcgcagggcaacaagggagataaacaggactgaaggagggcattgcaatggtgctgaatggt

SEQ ID NO: 8898 - DNA, 601 bp, Human
actcattccctaggtattttctgccagaggtaacagacttcagtctataaatgcctgattactaacatcttacattatgggttactaaacaggccgtttagtctgttttcaacaacgtcccagaaatgttttcaaaagttttatttcagccttatacacaagcaccctaaaacccctaaaaattctgacaagatcaataaatatttacaaaatagatttactttgtaaattttaatttcattggatatgttccctaaaattttatgaggttttatgtttttacagaattttatggtagackctttcaagaaagatggatatatttatctttacagatggtaagactggggaactgaggtaggagaatgactggtccagactgggagaggaaaaaaggagtctggacaccaccaaatctttaccagacctggggaggctccagggtggaagacggaaggggcggagccactggacctgagagggactgtttggaagttagtctgcttttgtgttgaaattcaaaatcagcatagaacctttaatcaactataattaacaggctacacttggaagctatggctaaaatttctaggctgtacca

SEQ ID NO: 8899 - DNA, 601 bp, Human
gagtccagaaaagttgaagaaggaggcagaacaggtcagacaagatgagatgatggaagccaggttcaaagaatgtgctagaaaaggacccaaccttccattgctggctttgaagatggaggaaggaggccatgggccaaggaatgtaggcagcctctagaagcaggaaaaggcaaggaaatgggatgtcccctcagcctttggaagggactgcagccctgccaatcggtaccctggatttagtccagtgagacccatgtcagacttctgacctacagaactgaaaacattcaaaaaataygaaaatagagtgatggttaagtattggttgttttaagccattgagtttatggtaatttgtttgatcagtgatagaaaactaatagtgttaaatattcttttccttcattcacattaaaatcaagaaagataaaactaaagttgttgaagtaatggacaaatttaaagatatcctttttgagaacacctttcctaatcactcccaaatgctgtcacttcttcatttgtccttactgcttatattatatcacttatcatttgttctactttattttataactgtgttaatatcctttcctgg

SEQ ID NO: 8900 - DNA, 601 bp, Human
acttgttgtatttttcatgaagtctagggcaacacagcaggtatttgtggtagcagaataatggccccctaaagatatccacgtcccaatccccaggacctgtgaatatgttaggttacacggcaaaggggcattcaggctgcagatggaattaagattgctaatcagctgactttcaaatagggaggtgattctagattatttatccaggtgggcccaatgttatcacaagagtccagaaaagttgaagaaggaggcagaacaggtcagacaagatgagatgatggaagccaggttcaamgaatgtgctagaaaaggacccaaccttccattgctggctttgaagatggaggaaggaggccatgggccaaggaatgtaggcagcctctagaagcaggaaaaggcaaggaaatgggatgtcccctcagcctttggaagggactgcagccctgccaatcggtaccctggatttagtccagtgagacccatgtcagacttctgacctacagaactgaaaacattcaaaaaatacgaaaatagagtgatggttaagtattggttgttttaagccattgagtttatggtaatttgtttgatcagt

SEQ ID NO: 8901 - DNA, 601 bp, Human
acctaggaactctttgaggttcagtggaggtgaaagagggcctgagtgttttagccctccttcactctcatagcaactatcagactccatggaaatgatctgacaattaagtacaacttgtaacgtctctaccaccatagctttcaactgttatctgattttcttttaactttttgtatgttcttgttctctccaactaggttataagcgacttgttgtatttttcatgaagtctagggcaacacagcaggtatttgtggtagcagaataatggccccctaaagatatccacgtcccaatccccaggacctgtgaatatgttaggttacacggcaaaggggcattcaggctgcagatggaattaagattgctaatcagctgactttcaaatagggaggtgattctagattatttatccaggtgggcccaatgttatcacaagagtccagaaaagttgaagaaggaggcagaacaggtcagacaagatgagatgatggaagccaggttcaaagaatgtgctagaaaaggacccaaccttccattgctggctttgaagatggaggaaggaggccatgggccaaggaatgtaggcagcctctag

SEQ ID NO: 8902 - DNA, 601 bp, Human
gaagtgctgaaaccccagcatctatataaccacctgtggaattagcagatttttctttattttgggattaaaatagtgcagacacaaagggactttcctgtggacaacagcaatagctgttttaaaaattctacaaactaagaataggagggagttttcttacactgataaagagtataaaaaaaatctgcaatcgatatcatactgaacggtgaaatgttgaaagctctccctaaatagaaatagaaaaagcccaccaaaatattaacaatgcttatttctgggtagcagaataataggyttagggtgattttttttgtgtgtatttttaaaaattttgagcttttctgtatttttaaaaatttcttgcaccacccccccatctattatttgtacaaaaggagcttccctgctgcatacaggatgaaatcccatctccttagtgtgacatattgtccttgtttagctttcccatctcttctttcatgcctcccctttgtcccccaaataggctcacacaccttttgctcacagccttttctatttcctttgatggtcttttccacctaggaactctttgaggttcagtggaggtgaaaga

SEQ ID NO: 8903 - DNA, 601 bp, Human
gtcattccaaagaattctgggacccacagtcctaacggcaaaacaagagtctctacaaataaacttccacaatttctgatttttttttttttttacttcactgagagtttccggtcaaacaggaagtgctgaaaccccagcatctatataaccacctgtggaattagcagatttttctttattttgggattaaaatagtgcagacacaaagggactttcctgtggacaacagcaatagctgttttaaaaattctacaaactaagaataggagggagttttcttacactgataaagagtatwaaaaaaatctgcaatcgatatcatactgaacggtgaaatgttgaaagctctccctaaatagaaatagaaaaagcccaccaaaatattaacaatgcttatttctgggtagcagaataataggtttagggtgattttttttgtgtgtatttttaaaaattttgagcttttctgtatttttaaaaatttcttgcaccacccccccatctattatttgtacaaaaggagcttccctgctgcatacaggatgaaatcccatctccttagtgtgacatattgtccttgtttagctttcccatctct

SEQ ID NO: 8904 - DNA, 601 bp, Human
accatgcccggctacttttttgtattttttagtaaagacggggttttgccatgttggccaggctggtcttgagctcctggcctcatgcaatccacccaccttggcatcccaaagtgctgggattacaagcatgagccactgtgcccagcccctcctgcctttatacttgagattattctaacactttgctgagatggattccaaggataatccagcaatatcatttttagtaaaaaccagcctacaaaggaaaatttatattttactcatatgactgaatcaggcccacccaggacttccycttggttgaggcacttaaggatatgggacttggattacatctatcaagtcctttcaggcagtgcctaaaccagcctttgtttggataattgggagagaaatggctagactttgactagggctgtcattccaaagaattctgggacccacagtcctaacggcaaaacaagagtctctacaaataaacttccacaatttctgatttttttttttttttacttcactgagagtttccggtcaaacaggaagtgctgaaaccccagcatctatataaccacctgtggaattagcagatttttct

SEQ ID NO: 8905 - DNA, 601 bp, Human
ttttccatagatcttttttaaaggttaaaaaagttaaccccatgtctttcctttttctttctttttttttttttgatggagtctcgctctgttgcccaggctggagtgcagtggcacgatcttggctcactgcaacctctgcctcctgagttcaagggattcttctgccttagcctcccaagcagctgggactacaggcgtgcaccaccatgcctgactactttttgtattttcagtagagatggggtttcaccattttggtcaggctggtcttaaacccctgaccttgtgatctgctcgyctcagcctcccaaagtgctgggattacaggcatgagccaccatgcctggccccttttttcattttttctttaagaaaagacatttattcaacaactacttattgtgctactgttctagatgtttgggtatagaaaagaacacaaaagactaaattgtctgccctcgtggaacttgtattttaatggagacaggaggatgataaataaatatttaaaaaataatatgtgctctaaagaaaggcaggtactgggggcagggggtagctacacagtgcctagaacacagtgcactgtcaacaa

SEQ ID NO: 8906 - DNA, 601 bp, Human
tctgaaattgtaggtgtgtttttgcttttatttttgggaggtgagaaaacaggttcactgagtccaggaggcaggccaagctcacataatgatgacactgggcaagatgctctgtgtcccttggagacacagtaactgaccaatgggtgtcccagtgactactttggcctggtgtgtaataccaggccacagaaatctctcagccatttaagaggcatgagcatggggaattttcctcttttgcacaaagtagtggcactcctaatcacctagtttctctactaaaactctttctggggaytttttggggtttgcctatacccatccatagtacttccgcaagatcagaggaagtacttgaaagaagtcagaacccatagcctaagtaggtttccccaagaatgttcataggagaagaaatctgctacctgattcttgatttccagggaccttcttctagggtggtagatactgagctccttgccattttttagaagcttgggttttctttctgaatgttcacataaggagaaaaccaggaacaaaaggaaaagagaccaagcttctgtgatgagctctaaaatcttcatgtcttgctggc

SEQ ID NO: 8907 - DNA, 601 bp, Human
ctggcgtggctggggatactgcaggagtgtatttgtttttcattaatttgtttgtcatttttctccatgatctatggaacatttatttcccctgaagcaaaaagacctgaaatgtcaaaggttttttggtttctgttggggtaatgaattgttgagaaaaagagattttttcttatatgctattttattgtagaaagagacattttgtgaccttttgctgttttacagtgataatgaattttctgacagacttggaaactttgggcttctatgttaaaataataaagtttgaggaataacmttgacctggacctttggagaattaatcaaatacagattttggaaaattgatgactttggtctttatcaagacactctagtttattactgtcatcaaggcagtacacagatttataccacataaaaacatccaacaattaactacagacccaagtccctgaacagagattttgacactcttggtggttgggaggtttaggcccaggagaccttcagcctgatcagtgttgctttgttgccttttttctttgttctttttcaaaaatttagttgcaaaagtaataggtacactgaattgaat

SEQ ID NO: 8908 - DNA, 601 bp, Human
catttgtaaggttcagggctttacccaaactacatggtgctcagcagaatggccatctagaatcttgcacggttcgcatttcatttcttctttcagaaaccccactttccttgggtttaaatggaaagaacccataaaataaagctcttttttttttttttttttttgagacagagtctcgctctgtcgcccaggctggagtgcagtggcgtgatctcaatctcggctcactgcaagctccgcctcctgggtccatgccattctcctgcctcagcctcttgagtagctgggacttcaggcrcccgctaccagaagggacatgcttttcaagtgtcttgcttgatctcctatcataatgaatccttcctttctccttaagcaaccttgctcaatcctctttttaggactaacttgattctgttttgcattgcaagcagttgtttatagatgccccctcccacccttgccctggccctctctggctccttaggggcagaggccatgtcccattgatctttacacttccctggggcctgcacagtgagcagtgaatacccgttgaaggagtttaatttctgcatggagttagatttatagttga

SEQ ID NO: 8909 - DNA, 601 bp, Human
aagaccagcctggccaacatggtaaatcctcgtctctactaaaaatacaaaaaaattagctgggcatggcagcacgtacctgtggtcccagctactcagctggctgaggtaggagaatgacttgaacccaggagacagaggttgcagtgaaccaagatcacaccactgcactccagcctgggtgacagagcaagactccgtccccctgtgccgccccccaaagaaagatctctgatatacaattaagatctctgtggatctctgatatacagctaagatctctgtagatctctgatacacractaagatctctgtagatctctgatacacaactaagatctctgtagatctctgatatacaactaaggctgcacaggcttgagcatctagggccgagacagctgcaatcttggatactcttagttatatctgagataaaagtcctgcatctgagatacatatctgagataaaaactcccatttgtaaggttcagggctttacccaaactacatggtgctcagcagaatggccatctagaatcttgcacggttcgcatttcatttcttctttcagaaaccccactttccttgggtttaaatg

SEQ ID NO: 8910 - DNA, 601 bp, Human
ttcaagaccagcctggccaacatggtaaatcctcgtctctactaaaaatacaaaaaaattagctgggcatggcagcacgtacctgtggtcccagctactcagctggctgaggtaggagaatgacttgaacccaggagacagaggttgcagtgaaccaagatcacaccactgcactccagcctgggtgacagagcaagactccgtccccctgtgccgccccccaaagaaagatctctgatatacaattaagatctctgtggatctctgatatacagctaagatctctgtagatctctgatayacgactaagatctctgtagatctctgatacacaactaagatctctgtagatctctgatatacaactaaggctgcacaggcttgagcatctagggccgagacagctgcaatcttggatactcttagttatatctgagataaaagtcctgcatctgagatacatatctgagataaaaactcccatttgtaaggttcagggctttacccaaactacatggtgctcagcagaatggccatctagaatcttgcacggttcgcatttcatttcttctttcagaaaccccactttccttgggtttaa

SEQ ID NO: 8911 - DNA, 601 bp, Human
tggtgaccactgttgtccttgttcactgaccaataatccaactgcttcactctctctggtttatgcttccctccccaaacccacacatccttcacagcttcctctctgttctttctctaggtgagctttggcaatttatggtaaaagcctctatccttgagctatatcctttatgttcccaggacccactcggcttcaacataagcaaatagaaatataaataaagataaaagtatgtgtagatcctgcagaatatctacagtcaggtctggggcaataaatgggtgcctttaagagtcaratctgatttgaacagaaataaatcaaattaagatctctgataggccgggcgcggtggctcacacctgtactcccagcactttgggaggccaagaggggtgaatcacctaaggtcaggagtccgagaccagcctgaccaatatggtgaaaccacctctctactaaaaatacaagaattagctgggtgtggtgccatatgcctgtactcccagctactcaggaggctgaggcaggagaatctcctgaacctgggaggcaagggttgcagcgagctgagagtacgccactgtactccagcctg

SEQ ID NO: 8912 - DNA, 601 bp, Human
tcttccggacttcagttcaatcagttctctactgggagagataaagaatgatcattagtaggcacaaaataacaacagctatggtgaccactgttgtccttgttcactgaccaataatccaactgcttcactctctctggtttatgcttccctccccaaacccacacatccttcacagcttcctctctgttctttctctaggtgagctttggcaatttatggtaaaagcctctatccttgagctatatcctttatgttcccaggacccactcggcttcaacataagcaaatagaaatatarataaagataaaagtatgtgtagatcctgcagaatatctacagtcaggtctggggcaataaatgggtgcctttaagagtcagatctgatttgaacagaaataaatcaaattaagatctctgataggccgggcgcggtggctcacacctgtactcccagcactttgggaggccaagaggggtgaatcacctaaggtcaggagtccgagaccagcctgaccaatatggtgaaaccacctctctactaaaaatacaagaattagctgggtgtggtgccatatgcctgtactcccagctactcag

SEQ ID NO: 8913 - DNA, 601 bp, Human
aaagcatctgggcctacattttcctgaagatggcttttcaaaatttctgtttttagctgacttcactcttctctatatgctattaggtaataagaaaagttccaaacattattcactgggatgctcaaaagtaagctacatgtgccatattactgtaagacaagtataaagggcttgcattttatttccacaaggaatgaataaagggaaaggaatttacttttgggaaaaggtaacacaaagaactttggtctatgaaggacacaaatgaattctcatcttcaaagatattttgaaatartataagaaatgacccatctgtggtagtttatggttgatctaagtaagacagcctcctggggccccttctttcttggagaaggcacttttcctatgatgccaggttcctagttcccgcctcttctgccacttctgcaggagccacccgaggccttgaggggccctttcagaaccttgggtctgaagtcatttcttatgccctgggttatcatcttcagtagaaagttggtggtagctacaacagcagcgagcactcaggccagtctgtaaaacacacaaaatgactttcctgaagatatac

SEQ ID NO: 8914 - DNA, 601 bp, Human
caaattaaacatgagatataatctctacctgaagtcatatagcatttacttatcacttttaaaaaatgcaaggccaggcacagtgactcacacctgtaatcccaacactttgtgaggctgaggtaggaggattacttgagtccaggaattcaagaccagcctgggcagcaaagtgagtccccatctctacaaaaaataaaaaattagttgggcatggtagcacatgcctgtggtcccagctattcaggaggctgaggtgggaggatcacttgagccagggagctcaaggctgcagtgagcygagaggatgcctttgtgctcatcctggaggacagagggagaccctgtctcacaaaacaaaaaaaaaagcagtgatttgtactccagataatagagtcatgcagtactataaaaatctcttctcattttgtatttattatgagtactggcaaaagagagggtcatcttcattttcttctgattttttaaatataaaatatttgctgaaattgttttctaatatacaaaattgtttgagtgaaagaaaaagaactataaaacacaagtaccaaacagtctccaataaaaacacttagataat

SEQ ID NO: 8915 - DNA, 601 bp, Human
tatagatcgtgtgaagcaatgaatatggaatccttcccatattttttccctaaaaactcagtataaaaagcagaaacttaatattgaaaaaacactaattataaaggcagatgaaaaagttaacagtgtattcacatttcatccatacattttttttttctttttggccaactgaactaatcctgtaccagtgattaaatattcagaatttttggccaagtgctgcctaagagagatccacttgactgttcaagcaattagaaaaagtgccacatccttgcatgtgcctccaagcaggaargagcacatcagggacatctgcatatgtgttcacatatgggattcacaggcaaatcaacttggaaatgggaaagtacacaaaggctaccccacttgagatgcaggtcagtatttacagagcagtgggcaggtgctcggctgtctgctaggtcctgggaaaggtacaggagaaacacaggcaagagcatgggcactgaacaggaaggaaaacaataccctggagggcacagccccctagcccaaaagaagagtatttacagtggggaggggaggacagagcatggacaaagtctcaacaagc

SEQ ID NO: 8916 - DNA, 601 bp, Human
caatcacaccagcaagagaaactagtaggacaactgaaattcatcacaggaggccacaaaagagttaattcagctctgatatgaggattatgagacaagggtataaggattacacacaatggatttataaaagaatacaattttttttaaaggacaaaagtagtgactagggacgtttgtttcagatgaagaaataaccatgttaaccttttaaacatttgcatctgtgaattgtagcggctcaacataaagcagattgcctacatccactgcagccattctggcatgagaaagttctctygcctaaagcaaaacagatgtgtgagaggaaaaagcaaagtctcttatgggtgtatcaacattcataattatatagttatctcaggaactatagatcgtgtgaagcaatgaatatggaatccttcccatattttttccctaaaaactcagtataaaaagcagaaacttaatattgaaaaaacactaattataaaggcagatgaaaaagttaacagtgtattcacatttcatccatacattttttttttctttttggccaactgaactaatcctgtaccagtgattaaatattcagaatttt

SEQ ID NO: 8917 - DNA, 601 bp, Human
tcattctctccctaagaacctaaattccatcaagaggacacaatcacaccagcaagagaaactagtaggacaactgaaattcatcacaggaggccacaaaagagttaattcagctctgatatgaggattatgagacaagggtataaggattacacacaatggatttataaaagaatacaattttttttaaaggacaaaagtagtgactagggacgtttgtttcagatgaagaaataaccatgttaaccttttaaacatttgcatctgtgaattgtagcggctcaacataaagcagattgcytacatccactgcagccattctggcatgagaaagttctcttgcctaaagcaaaacagatgtgtgagaggaaaaagcaaagtctcttatgggtgtatcaacattcataattatatagttatctcaggaactatagatcgtgtgaagcaatgaatatggaatccttcccatattttttccctaaaaactcagtataaaaagcagaaacttaatattgaaaaaacactaattataaaggcagatgaaaaagttaacagtgtattcacatttcatccatacattttttttttctttttggccaac

SEQ ID NO: 8918 - DNA, 601 bp, Human
aactggattttaaagcatttgtaggtctgtgcagccacatcacactgttgcctcctattaagttccttgtcagtcactcctcctcaccctgcgctttgcaggtggcccacgcacagcactctacattgacctgatgacattctggcctattagatttgcctcattatgctccaccatcagcttctcctggattccaacttcatcgtctccatactcacgattactcataggccctctggcctctggaatgtgataaatatggttttggtagcttccttcaagtcacaccaccggaatgtgscatgtggacaggaagctagacaagacggttacctcaaatgggcagacatccccaagaactctacagttccatttaagactccaccagctggcatgctctcgccatgcttactcttccgctccctgtcacctccgattagctactctttctccactttcctgcaaccatatctgtggtctgcactggcagaaagctgggccatgaaggtgggaaatggctgaggacaatacagtgagtgcagagcattccgtgttggggtgtggtgatggaaggggtgttttgggaacacgagggtggtag

SEQ ID NO: 8919 - DNA, 601 bp, Human
taagttaggaactaaagggatgacaataatcaaacaaaattaacccaaatgcagagaaaatacaaaacaataacaaagtcacagtgtcccctggcatgtgtaacaactgtatacctgaaggatgtcataggctgttaatatgtaaagatctttagagatcttcttctgcatgcaacatgcagtatcagataccatcagagaaataataatatctttcatatgaacaaccatcatttactgagatggcccccttcagaaacttacagggaacaaaatgtgattcctggactggcacttctcwtctggatatattacaggattgatgctttcagcctcctgtatccatgcaactggattttaaagcatttgtaggtctgtgcagccacatcacactgttgcctcctattaagttccttgtcagtcactcctcctcaccctgcgctttgcaggtggcccacgcacagcactctacattgacctgatgacattctggcctattagatttgcctcattatgctccaccatcagcttctcctggattccaacttcatcgtctccatactcacgattactcataggccctctggcctctggaatgtga

SEQ ID NO: 8920 - DNA, 601 bp, Human
gacgatgaatagagcaggaaaaaggactgctaggtctggaatggcatcactggaagaacacgtgagagatgttgcttttggaggaagatgaattgcatgacattagcaattgaacgtgtaggtttagaagtgctgatggatttgccacaggtgcactctcactcacactcctcagcacgctaggaataaaactgaaactgcaacatggcccacagtgtctgcgtcatctgccctgtctccttcttgggatcacactctgaccacatttctcggcctcccttgcagttgggtgtgtgctggmggaatgtgagtgcggttgggagcaccacttccaggcaggcctgggcccagaaaaccctctcatgcacagccttccatgcagagaagcacgctggccttggcaggtcattaaaaatggcagagctgcaaaatgaaaggagctgtggtctccaagacactgctttgaacagggatatctaactgctcaggaatatctagtttgcacttctgcaaatgagaaataaatgtctatactgttcgaatgtcagttttggtttgttccagcagccagcgttatcttaactaatctgtcattctccca

SEQ ID NO: 8921 - DNA, 601 bp, Human
taggtacttggaagcaagtaaaatttttttttagcagggatgaaaggcctgttttagaaagacacatctccatgttcattatactctgattactaattaagtttctaggatgacctgatagtacaaaaaagttgctctatacaacagccaggaataactctgtcactggaaggggatagtctacattgtaaatacgtaccttagcattctgtatcagagcagaaagaaaccaattgaagagcctagtcggggaagtactgaaccagtccagggttggattggtcaagtaagtctagacgaygaatagagcaggaaaaaggactgctaggtctggaatggcatcactggaagaacacgtgagagatgttgcttttggaggaagatgaattgcatgacattagcaattgaacgtgtaggtttagaagtgctgatggatttgccacaggtgcactctcactcacactcctcagcacgctaggaataaaactgaaactgcaacatggcccacagtgtctgcgtcatctgccctgtctccttcttgggatcacactctgaccacatttctcggcctcccttgcagttgggtgtgtgctggcggaat

SEQ ID NO: 8922 - DNA, 601 bp, Human
agatttgaatttggcagcttggttatgaagctcaacagacagacattctgagattgctgaagcctcagtcctctctcaacccatgttaactttcacatccataatcccagcatgcttcctgagaaatgccaaccgttagacactttagccacattcatgaagtgactcacttgaggggcaggatctgaagctgtgctggctagccgagtctggagagagactccctccctaacagtcagtttgtctcttttccttcccctgatgctggtgctcacctactcacatgaaggatgatgtgtayggcaaaatcctacttctgaacccgcatacggaaaaccaattaagacggggagaaaaatgaaacagaactgtatttcccatctgactcaaacaagaatgtttagaatcaggcagatttagaaatagaatgcaggagcctgctatcatagtagaggctcattttactagaggatggtaccctacaaaggtgtaggtgagcagaaccccacagagtcaaggcagattttgaagctttggctggttgatctgatgccctctcctggctctcatagggtttggcagatgaaaaatctggatagaa

SEQ ID NO: 8923 - DNA, 601 bp, Human
ctcaagtgctcaagaatctgtagatgcagatttgaatttggcagcttggttatgaagctcaacagacagacattctgagattgctgaagcctcagtcctctctcaacccatgttaactttcacatccataatcccagcatgcttcctgagaaatgccaaccgttagacactttagccacattcatgaagtgactcacttgaggggcaggatctgaagctgtgctggctagccgagtctggagagagactccctccctaacagtcagtttgtctcttttccttcccctgatgctggtgctcrcctactcacatgaaggatgatgtgtatggcaaaatcctacttctgaacccgcatacggaaaaccaattaagacggggagaaaaatgaaacagaactgtatttcccatctgactcaaacaagaatgtttagaatcaggcagatttagaaatagaatgcaggagcctgctatcatagtagaggctcattttactagaggatggtaccctacaaaggtgtaggtgagcagaaccccacagagtcaaggcagattttgaagctttggctggttgatctgatgccctctcctggctctcataggg

SEQ ID NO: 8924 - DNA, 601 bp, Human
aggtgggcctgccccctccgggaagcttggtgatgccatccctcctgaccccaggagcccatactggggtagcagtggcaacaattacagtgcagaaaactgaagctggctggtgttcttccaagggcagccctccacaacattgctgtccatggcccaaacccaggcatgttacacaaaccctgtagtcactgacatgagggccactaggtgatgcttgccaaaggtaaaaaagcaaacatttgagacaactctttccagcctcctctagttcttgacagcagcccccgaaagtaaggaygttttatattttgagaagttatcagggtttcacatgaactgggattcagaacacaatttctctttccaatgaaaactggaaacacatctgagacagtaagcaaagacggtttcttagctctgcaattgacttagaatgaaatatgaaggaggtgccacccagctcttcagagcagctttgaaaaggtccagcttcagagggcacccgcctcaagtgctcaagaatctgtagatgcagatttgaatttggcagcttggttatgaagctcaacagacagacattctgagattgctgaagcct

SEQ ID NO: 8925 - DNA, 601 bp, Human
taatcatcctccaattaaagtgacaacagacagccatctccagttctggcaccagcagatgctaatcgaatacagaactagggccaccattgaattcacatttttggtctgtctctgtctaaatacacgtttttttaagtaattggtagagtctgtcaacaaatggttataaataggcattgtgtgtaaaaaaaaaaaaaaaaagggaaactaaacccaaaatattcctcttcagcctgtgattatgatgatgagcatggcccaggctgagtctctggcaagggatgaaaggagaaagacmcccccgccccctacatggcatttagtgcaatcccaaccacaaagcctcaccatccaaaacgccttgctgaaggctgagctcaccctgtgttgtacggttcatattccggtgtgcaggaaagacgtgtctaggctctgagcacagttttggataaggatgaaataatgttcatttaatacttaatttggaaaaagggccctgcccacggaatcagccttttaatggctgtcaggtgggcctgccccctccgggaagcttggtgatgccatccctcctgaccccaggagcccatactggggt

SEQ ID NO: 8926 - DNA, 601 bp, Human
cagaaaatgcactgagcttttaacatataatggccataataaacatgaacttgcggatctgatgagctggtaacaacaaagataagattggaagaaaagcaagtatttttttctaatcatcctccaattaaagtgacaacagacagccatctccagttctggcaccagcagatgctaatcgaatacagaactagggccaccattgaattcacatttttggtctgtctctgtctaaatacacgtttttttaagtaattggtagagtctgtcaacaaatggttataaataggcattgtgtgtaaaaaaaaaaaaaaaaagggaaactaaacccaaaatattcctcttcagcctgtgattatgatgatgagcatggcccaggctgagtctctggcaagggatgaaaggagaaagacccccccgccccctacatggcatttagtgcaatcccaaccacaaagcctcaccatccaaaacgccttgctgaaggctgagctcaccctgtgttgtacggttcatattccggtgtgcaggaaagacgtgtctaggctctgagcacagttttggataaggatgaaataatgttcatttaatacttaatttg

SEQ ID NO: 8927 - DNA, 601 bp, Human
aagcccagccttctcacttccttctcacatcattccttcgatggtgctccactcctgtatttcacatagggatattgacatccatctgctggccttggccatcaaaacaggttcaacctcttcagcttgtctctccctgtatccaccatggacaatagcttacctactctctctggctccatcacctttctgctgcccccgtgagccatcctgctttttggggtaagggtaggaatcacagagatcctgtatattcagctgcccctaagatagctttatgggtaacccctctctaatgtcygatgtgcactgccaagtcctggactctcaaactgggtgccttgtctccacttcttctggctgtatttaaggtggaaaaaatatatggactgagaaaagaacagggaggaggatggaattctggaaagaaacaccatttgaaaggcaaagcataggggaaggggcctctaaaaggctgagaaggaggagttagactagaagaaggcctcagaagccaggggaaatactccatggagaaaatggttaatgtcaaagagagggaaagtatgagaaagcaggaaaggagataactggatttggc

SEQ ID NO: 8928 - DNA, 601 bp, Human
taggatggtgagttagtgggtcggggtccaggttcaccatctccatttcaacagagttcaactccttaaggaagaatctataatatctgctaaatatgttgtacttctctacatttttttaatttatttttttattttttgagataaggtcttacactgttgctcaggctaaaatacagtggtgagatcacagcttactagcttactgcagccttgaacttcttggctcaaatgatcctcctacctcagcctcctgagtggttaggaccacaggcatgtgctaccatacctagctaatttwaaaaaaattagaaaaaaaatttttaaagaggccactatgatttttgtaattgtttccctacgttacctggctggtctgaaactcctggcctcaagccatcctcccaccttggcttcccaaagtgctgaggtattataagtgtgagccaccacacctggcctacatttttgtttgaagaaagggtctatggctaatatatatagtttgaaatacactaattagtgattccaatgggttcaccaaaaagggaagggactgaggggagggctggagatacttctgatcttcatgaaaggcaat

SEQ ID NO: 8929 - DNA, 601 bp, Human
agcaatcctctcactccagccttccaaagtgctgggattacaggcatgagccaccatacccacccaatttcatccttttgtatatagatatctcagttgtctccagaaccatttgtctgagagagtatttttttcctctttaattgtcttggtatccttgtcaaaacccaattgaccataagcatgagggtttatttctggactctcgatgccattccattgatctatagttattaaaaaatcgataaccatctatctatctatctatctatctatctatctatctatctatctatctatmtagatacaggtttcactatgttggccaggctggtctctagctcctggcctcaagcgatccagcctcccaaagtgctgggattacaggtgtgagccacacacatagctgatctatgtctattcttatgccagtaccacactaccaggacttgtcaagcttagtagtaaccttagaaatcagcaagcctgagtcctcccacttttattttttcccaagattgctttggccgcactgggtgttttcactattaacttgacagtgtattggataaactgtcaggacccaagacaggaggcagag

SEQ ID NO: 8930 - DNA, 601 bp, Human
gattacaggtgcatgccaccatgcccagctaattttttgtatttttagtagagacagagtttcaccatgttggccaggctggtctggaactcctgacctcatgatccgcccgccttggcctcccaaagtgctgggattacaggcgtgagtcaccgcacctggcctgattttattggtcttttcaaacaacaaacttttggccttgtagatcctatctgtagtatgtttgttttctatttcattaacttcttttatctttattatttccctccttttattttctttgggcttaatttgttattttttttataaccttttgaataacagatattcaacattttcatttctaatacggactatgaattatccaagcaccaatgtaaaaaacatgtagtctgaagttgttgggctcaatgctctgtatatcatttaggtcaagtttgttaactatggtgttcaaatcttttatatctttatggacatttttgtttgtttgcttgttctatcagttactgagagaggtatgttaaaaatctcttctatgactggataattattttgaaaactccctctttaattctaatagtgctttcctccttta

SEQ ID NO: 8931 - DNA, 601 bp, Human; identical to SEQ ID NO: 945

SEQ ID NO: 8932 - DNA, 601 bp, Human; identical to SEQ ID NO: 1042

SEQ ID NO: 8933 - DNA, 601 bp, Human
gcatccacaatgcctatttcaatgcccagcccataccaggtactcaataacagttttttagatgaatgaataaaaattcaaacacttataagttttatttagttattttaatcaaggttaaaaacagagccagcttcatgggtatgtgacctgggcagtttcacagggccccatgccccaaagggcccctggcttggtttaatgctttgcagtcactgtgaaattttcaataatatgaacaaggggactcacattttcattttgcactgggccccacatattatgtagccagtacttcttaaaaaaaaaaccacacgtttctataaattttcagtaaatggatattttagatgcatgtgaatgccaaattacccatagaaatttatctttaaaattaaaaaagtatatttcaggcttacctgaaatggtagattgtggtttttctttcttaaaatatggttcatactctctgtagacaattttcttaaaggaagttacagaaagattcaaactggaaataaaatacaaaaactaatttgaaaggcatattcaatatctatttctcacattacaaaaaaagtagatctctcatatcttcaga

SEQ ID NO: 8934 - DNA, 601 bp, Human
gttatccccaatagctgattggctcctggaaatcaaggtccatgtcttattcactttatcccagagcctagaatgtagtaggttctcaatatacttttttgttgttgttgttgttgtttttttttttttgagatagagtttcgctctgtcacccaggttggagtgaagtgatgcgatgtcagctcactgcagcctccacctcctgggttcaagtgattctcatgtctcagcctcctgagtagctgggactacaggcatgtaccatcatgcacaactaatttttgtattttcagtagaggckgggtttcaccatgtgggccaggctggtctggaactcctgacctcaagtgatccatctgccttggcctcccaaagtgcatgagccaccacgcctggcctcaatacacaattatttaaaaataaaagaatatttaaatgcagatctgtttaaaattaaataaatatataaatgaacacatgtgaagactatataaatgagtggagaaatatagatatatagatatccataatactatgatatatatgatctaagttatgattagtaatagcagcaacaataacaataatgtagctaacttct

SEQ ID NO: 8935 - DNA, 601 bp, Human
cttattactctactgtcattgcttgtctatccataggttatccccaatagctgattggctcctggaaatcaaggtccatgtcttattcactttatcccagagcctagaatgtagtaggttctcaatatacttttttgttgttgttgttgttgtttttttttttttgagatagagtttcgctctgtcacccaggttggagtgaagtgatgcgatgtcagctcactgcagcctccacctcctgggttcaagtgattctcatgtctcagcctcctgagtagctgggactacaggcatgtaccaycatgcacaactaatttttgtattttcagtagaggcggggtttcaccatgtgggccaggctggtctggaactcctgacctcaagtgatccatctgccttggcctcccaaagtgcatgagccaccacgcctggcctcaatacacaattatttaaaaataaaagaatatttaaatgcagatctgtttaaaattaaataaatatataaatgaacacatgtgaagactatataaatgagtggagaaatatagatatatagatatccataatactatgatatatatgatctaagttatgattagta

SEQ ID NO: 8936 - DNA, 601 bp, Human
tcacccaaccccttgcctccccacttggctttccaagatcctactcttttttcagctatcaatctagaaatagaaatactttcctgaccaccagactggagataggtctcctatgtcctactacagaatcctcatcatagttcttccttattactctactgtcattgcttgtctatccataggttatccccaatagctgattggctcctggaaatcaaggtccatgtcttattcactttatcccagagcctagaatgtagtaggttctcaatatacttttttgttgttgttgttgttgttkttttttttttgagatagagtttcgctctgtcacccaggttggagtgaagtgatgcgatgtcagctcactgcagcctccacctcctgggttcaagtgattctcatgtctcagcctcctgagtagctgggactacaggcatgtaccatcatgcacaactaatttttgtattttcagtagaggcggggtttcaccatgtgggccaggctggtctggaactcctgacctcaagtgatccatctgccttggcctcccaaagtgcatgagccaccacgcctggcctcaatacacaattatttaaaa

SEQ ID NO: 8937 - DNA, 601 bp, Human
acccctgtcttgccacccacggttgtcctattcctttccttgaactcctactcctggagtttattctgatcttgtgcctgaagctttttgtttgtttttatgttagctttacacaggactgtggaggtcacaaagttcagtccttattttagttaacaaagcctgggaggtaggaatcgggggacaaaggtgacttgcccaaggtcagtcagtgatctggtagcattgctgggatcagaactcagatctctggactcctgagccaaagctctccctattccttccacggggcaggctcagrcccccatctttatagaatagtccagatgtctacacctcttttgactcctgacatgtcggactccactgactgacccccctcttccagctgctaccctctgtcttggctcctgatggaagtttccactgactattcccacctaccccagctgccaatgagcccaacagggtgctgactatgctgccaattgtgtgccgcatttagttgccatggttctcttgcttggttgatttgtttgttggcatcacatgcctgcaaataccagatgcccagagaaagtctcctaagttatttaaccta

SEQ ID NO: 8938 - DNA, 601 bp, Human
cctatctttccctacccctgtcttgccacccacggttgtcctattcctttccttgaactcctactcctggagtttattctgatcttgtgcctgaagctttttgtttgtttttatgttagctttacacaggactgtggaggtcacaaagttcagtccttattttagttaacaaagcctgggaggtaggaatcgggggacaaaggtgacttgcccaaggtcagtcagtgatctggtagcattgctgggatcagaactcagatctctggactcctgagccaaagctctccctattccttccacrgggcaggctcaggcccccatctttatagaatagtccagatgtctacacctcttttgactcctgacatgtcggactccactgactgacccccctcttccagctgctaccctctgtcttggctcctgatggaagtttccactgactattcccacctaccccagctgccaatgagcccaacagggtgctgactatgctgccaattgtgtgccgcatttagttgccatggttctcttgcttggttgatttgtttgttggcatcacatgcctgcaaataccagatgcccagagaaagtctcctaa

SEQ ID NO: 8939 - DNA, 601 bp, Human
gtgagtgtaggcagcttccagtaactggaaaagacaaggaaacaattctcccccagagcctccagaaggaatgcagctctgccaacaccttgattttagcccaataaaacccattttggacttctcatctgcagatatataatcataaaagaataaatttgtgttgttttagccactaagtttgcagtaactggttacagaagcaatggtaaactctgatttctgggacagaggtcctatctttccctacccctgtcttgccacccacggttgtcctattcctttccttgaactcctactsctggagtttattctgatcttgtgcctgaagctttttgtttgtttttatgttagctttacacaggactgtggaggtcacaaagttcagtccttattttagttaacaaagcctgggaggtaggaatcgggggacaaaggtgacttgcccaaggtcagtcagtgatctggtagcattgctgggatcagaactcagatctctggactcctgagccaaagctctccctattccttccacggggcaggctcaggcccccatctttatagaatagtccagatgtctacacctcttttgactcctgac

SEQ ID NO: 8940 - DNA, 601 bp, Human
ggactgtgtatctatgattaagaatcttgagatgagattcttctgggctgtccaggtggatcccatgtaataacaaaggtccttatcagagggatgcaggagaatctgagttaggaagagcttggaagatgctactcagctggttttgaagatggaggaaggggccatgagcccgtgagtgtaggcagcttccagtaactggaaaagacaaggaaacaattctcccccagagcctccagaaggaatgcagctctgccaacaccttgattttagcccaataaaacccattttggacttctcrtctgcagatatataatcataaaagaataaatttgtgttgttttagccactaagtttgcagtaactggttacagaagcaatggtaaactctgatttctgggacagaggtcctatctttccctacccctgtcttgccacccacggttgtcctattcctttccttgaactcctactcctggagtttattctgatcttgtgcctgaagctttttgtttgtttttatgttagctttacacaggactgtggaggtcacaaagttcagtccttattttagttaacaaagcctgggaggtaggaatcg

SEQ ID NO: 8941 - DNA, 601 bp, Human
gggactgtgtatctatgattaagaatcttgagatgagattcttctgggctgtccaggtggatcccatgtaataacaaaggtccttatcagagggatgcaggagaatctgagttaggaagagcttggaagatgctactcagctggttttgaagatggaggaaggggccatgagcccgtgagtgtaggcagcttccagtaactggaaaagacaaggaaacaattctcccccagagcctccagaaggaatgcagctctgccaacaccttgattttagcccaataaaacccattttggacttctsatctgcagatatataatcataaaagaataaatttgtgttgttttagccactaagtttgcagtaactggttacagaagcaatggtaaactctgatttctgggacagaggtcctatctttccctacccctgtcttgccacccacggttgtcctattcctttccttgaactcctactcctggagtttattctgatcttgtgcctgaagctttttgtttgtttttatgttagctttacacaggactgtggaggtcacaaagttcagtccttattttagttaacaaagcctgggaggtaggaatc

SEQ ID NO: 8942 - DNA, 601 bp, Human
ccactccctgccttcatagagtttataaaagtcaaacatttttatagttctataactttatacgtttttatagtaggaaagacagattttaaacaaatgatcacaaaaacattcaatttaaacctatggtaaatattatgacagaaaaggagggaatactctgaagagtatttgacagtggaatctagtccaattggaggtgagttggggaatcccttcccgaggaattaatcctttaactgaggtccaaaggcagagaggaaaagggatggccaaagacattctaaaaagttagagtagygtgcgcaaaggccctgaggtgccagaaaatgtggcctttttagagaactgacagttatccagtggggaggtggagcttagtatgtgaaaggaaggggcagaaggtgaagccgaaggcatcctcagagtcccatcatgcagggctttgtaagcctcatagagttttccctttagcctaagagtatctggaagccattaaagagttttcatcaggggtgcaacatggaccagattttggttttaaaatctctggctgtatttgtggaggatgatctcggaggagactgagcagagaacaatt

SEQ ID NO: 8943 - DNA, 601 bp, Human
tttatttattcaatgaatatcaagtgcctatattatcctaggcatcagaattgcaatggtgcgtaaaagagtaaaatagatacacccactccctgccttcatagagtttataaaagtcaaacatttttatagttctataactttatacgtttttatagtaggaaagacagattttaaacaaatgatcacaaaaacattcaatttaaacctatggtaaatattatgacagaaaaggagggaatactctgaagagtatttgacagtggaatctagtccaattggaggtgagttggggaatccyttcccgaggaattaatcctttaactgaggtccaaaggcagagaggaaaagggatggccaaagacattctaaaaagttagagtagcgtgcgcaaaggccctgaggtgccagaaaatgtggcctttttagagaactgacagttatccagtggggaggtggagcttagtatgtgaaaggaaggggcagaaggtgaagccgaaggcatcctcagagtcccatcatgcagggctttgtaagcctcatagagttttccctttagcctaagagtatctggaagccattaaagagttttcatcagggg

SEQ ID NO: 8944 - DNA, 601 bp, Human
tacagtccctgtactgaaggaactcacaagctagtttggagatagatgtatgataggagcgactgctgagatatgggcaaaatattacagaagaagagaggatgaagcacaaattctgtctggggagttagggaaaaagttgatggctgagtcagaatttgaggaattgtatatagtcagccctccatgaccatggttcatattcatggttacacatccatggagtcaaccaattttggatcaaaaatattcaaaaaacaacaataaaaaataaacaataaaaacaatacaaataaaactmtaacataatagcaatttacatagtatttacattgcattcagtattataactaatttaaagatgatttaaagtatatgagaggatgtgcataggttattgcaaatactatgaaattttatataagggacttgagcatctgcaaattttggtatctgtgagtagtcctggaaccaataccctgtggataccaagggatgactgtactagaatttccaaagtgtagtccttggagtctctgcatcagaatcacctagggtcttaataagaggcagatttccaaatatcacctcagcctcaatg

SEQ ID NO: 8945 - DNA, 601 bp, Human
atgatgttattagttactgcaatgggagaacacagcagagacaggaggttatgggtgcagaaatcaagaatgaggttttactttctacatgccaggcactgtgttagaaagtttctggctacctggatcaaatacagtccctgtactgaaggaactcacaagctagtttggagatagatgtatgataggagcgactgctgagatatgggcaaaatattacagaagaagagaggatgaagcacaaattctgtctggggagttagggaaaaagttgatggctgagtcagaatttgaggaattrtatatagtcagccctccatgaccatggttcatattcatggttacacatccatggagtcaaccaattttggatcaaaaatattcaaaaaacaacaataaaaaataaacaataaaaacaatacaaataaaactctaacataatagcaatttacatagtatttacattgcattcagtattataactaatttaaagatgatttaaagtatatgagaggatgtgcataggttattgcaaatactatgaaattttatataagggacttgagcatctgcaaattttggtatctgtgagtagtcctgg

SEQ ID NO: 8946 - DNA, 601 bp, Human
gacatttttgtaggtaaggcaaacaagacttgctgatggattgcatgtggcttgtgagagacagaagtcaaggatgacctcaaggtgttttatcagaacaactgggtaaatgatgttattagttactgcaatgggagaacacagcagagacaggaggttatgggtgcagaaatcaagaatgaggttttactttctacatgccaggcactgtgttagaaagtttctggctacctggatcaaatacagtccctgtactgaaggaactcacaagctagtttggagatagatgtatgataggagygactgctgagatatgggcaaaatattacagaagaagagaggatgaagcacaaattctgtctggggagttagggaaaaagttgatggctgagtcagaatttgaggaattgtatatagtcagccctccatgaccatggttcatattcatggttacacatccatggagtcaaccaattttggatcaaaaatattcaaaaaacaacaataaaaaataaacaataaaaacaatacaaataaaactctaacataatagcaatttacatagtatttacattgcattcagtattataactaatttaaa

SEQ ID NO: 8947 - DNA, 601 bp, Human
ttctggccaagtcttgcccactttgacccactgtcattccttagcaataactttctttgcttaagaaagatgttcatttcaattacagagggtgatgcgagagggtagttactttagatttctctgacatgggtgtgctcagagacctagatgaattgaggaaccaaatcacacagctctctggctctgaggcaggagtagtcttgatgtatctaaggaacagtaagaaaaacagtacgggaagaaagaagagatgaggtggatggtaggtgtgtagaacaagggaggccctatgggctayggtaagaacttgaattttcttctaagtgaaatgggacatcactggagcatttttctttttttttttgagatggagtctcgctctgtctcctaggctggagtgcagtgatgcaatctcaggacccactgcaacctccgcctcctgggttcaagcaattctcctacctcaacctcccaagtagctgggattgcaggcatgcaccaccacacccagctaatttttgtatttttagtagagatgacttttcaccatgttggccaggctggtctcaaactcctgacctcaggtgatacacccgcc

SEQ ID NO: 8948 - DNA, 601 bp, Human
agttctcttatgttctgttgtggtttctcaagccagtgtaatactatcttaaccccctaccacctatctctcaaatatctacctctgagatagaggaatctggattctcatgtaactggctcagcatgcagttagtttatccccactcccaaaaaaatagctcaaaccacagagggaggctataggtgagggtgagtgtcagacatggaggaggagatgttttattttaatgcagagggcataataaaatcaacttataaggcttgtcttttaccataaaagatactatctgcttactagrtttgcatctcatttccaaggtaaaattttactttccctaccaatatgtatttacctttcttagattcataggaccagaggcaatattatatgccaataatcatgtctccagtgaaagctgtgggagcattttaagcaattgctcataaataattgctggctgtagggaatgtagggacaaataaacagtaaaggaagagggatagtgttgcaaggttcattcactgtgcaaacagcccaggtagggtccaaagtctacaattcttacctcctcccttatttgaaatgaaacctgcatgtg

SEQ ID NO: 8949 - DNA, 601 bp, Human
gatccacatttttgtgatttattaaatatacaaactatagccgttatagtttgtttcaggtgtttatcatatactcaaggaagtctctacataaggccaaaatattcagatgagaagtgaaaaaatgtaatcacctacattaagtcaagcattggaatgttttggaaaaatctagaagagcaaatttttgtatagagaatttggcaacacttagatacaacgaacaatgtctggcagaaaacgtgttttatttggagagctggcttaccagcagatggctatatattatagaactaatttkgtgacatcacattcatatgcaactcatatatttaaaatatgagaatataactaaaagaaaagaataatattaaattctccatgaaacaagctttttaaaggtaattgaccaaaacgactttgaaaattttactgaacaacaaactttgctcaaaggtgcagcattgaagtcaatttgatgcatgctagttacagagtttctgaaaatttaacctcaaattgaaaccctttagtgacagcttttaagtgattagttacagttgcagatactttattccctgatctaagacagtcttattaa

SEQ ID NO: 8950 - DNA, 601 bp, Human
tgacgttttataaagagctgatttcattgcacaggacttgcaagtctctttggaaaagggatccacatttttgtgatttattaaatatacaaactatagccgttatagtttgtttcaggtgtttatcatatactcaaggaagtctctacataaggccaaaatattcagatgagaagtgaaaaaatgtaatcacctacattaagtcaagcattggaatgttttggaaaaatctagaagagcaaatttttgtatagagaatttggcaacacttagatacaacgaacaatgtctggcagaaaaygtgttttatttggagagctggcttaccagcagatggctatatattatagaactaattttgtgacatcacattcatatgcaactcatatatttaaaatatgagaatataactaaaagaaaagaataatattaaattctccatgaaacaagctttttaaaggtaattgaccaaaacgactttgaaaattttactgaacaacaaactttgctcaaaggtgcagcattgaagtcaatttgatgcatgctagttacagagtttctgaaaatttaacctcaaattgaaaccctttagtgacagctt

SEQ ID NO: 8951 - DNA, 601 bp, Human
agtcagctttgtattgtatttattcttgtcatgatgtactaattacttgccaaaggctctcagtattttttaaaaatgaaaaatggtgcatacaagctttgggaaagtgaagttacataaagagcctttttggttactcattagggtgctcactcagtaactcttcccttgttacttatttttgtgaacaactcttttcctctcctaagttaataaacttagtgaatgcttcactacattcaaagattcagaatattcttttagaagctataatgtaggcaatgggcgaatcaatgctgaygttttataaagagctgatttcattgcacaggacttgcaagtctctttggaaaagggatccacatttttgtgatttattaaatatacaaactatagccgttatagtttgtttcaggtgtttatcatatactcaaggaagtctctacataaggccaaaatattcagatgagaagtgaaaaaatgtaatcacctacattaagtcaagcattggaatgttttggaaaaatctagaagagcaaatttttgtatagagaatttggcaacacttagatacaacgaacaatgtctggcagaaaacgtg

SEQ ID NO: 8952 - DNA, 601 bp, Human
taagtttagtatactactaaaagttgaattatgagcatcttgaaacagtgaatgatatagacttgtacataggatatattctataattacactgagtgagatggctaatgagacaattggggtgtaattttatcaatgcttttattcttttcacttcaaattattttacctttagtctagaataaaacaggtttgttgtatctttgattttacaacatacattaatataaagtataaaatacaaacagctattaagaggaagcatttgtgagatgcagttttggtgaatgtgattttgactttgtaatcaaaataaaaaaaattaagctctaaactgaaaagaagagaaatggacagggacaactattgtgctagagcacaagaagtccttgttcagctgcttgctggaataaaatctttacacaagggtagctcttcatttatatttactcagttctgttcatttcctgctcagtcgatagtcagctttgtattgtatttattcttgtcatgatgtactaattacttgccaaaggctctcagtattttttaaaaatgaaaaatggtgcatacaagctttgggaaagtgaagttacataaa

SEQ ID NO: 8953 - DNA, 601 bp, Human
cctgtcagttacatataagatgaatttcaaataattaaatgaatgatgttaattaagtttagtatactactaaaagttgaattatgagcatcttgaaacagtgaatgatatagacttgtacataggatatattctataattacactgagtgagatggctaatgagacaattggggtgtaattttatcaatgcttttattcttttcacttcaaattattttacctttagtctagaataaaacaggtttgttgtatctttgattttacaacatacattaatataaagtataaaatacaaacarctattaagaggaagcatttgtgagatgcagttttggtgaatgtgattttgactttgtaatcaaaataaaaaaaattaagctctaaactgaaaagaagagaaatggacagggacaactattgtgctagagcacaagaagtccttgttcagctgcttgctggaataaaatctttacacaagggtagctcttcatttatatttactcagttctgttcatttcctgctcagtcgatagtcagctttgtattgtatttattcttgtcatgatgtactaattacttgccaaaggctctcagtattt

SEQ ID NO: 8954 - DNA, 601 bp, Human
attgatcaaactaaattactcagaatttcacattcgcctgtcagttacatataagatgaatttcaaataattaaatgaatgatgttaattaagtttagtatactactaaaagttgaattatgagcatcttgaaacagtgaatgatatagacttgtacataggatatattctataattacactgagtgagatggctaatgagacaattggggtgtaattttatcaatgcttttattcttttcacttcaaattattttacctttagtctagaataaaacaggtttgttgtatctttgattttrcaacatacattaatataaagtataaaatacaaacagctattaagaggaagcatttgtgagatgcagttttggtgaatgtgattttgactttgtaatcaaaataaaaaaaattaagctctaaactgaaaagaagagaaatggacagggacaactattgtgctagagcacaagaagtccttgttcagctgcttgctggaataaaatctttacacaagggtagctcttcatttatatttactcagttctgttcatttcctgctcagtcgatagtcagctttgtattgtatttattcttgtcat

SEQ ID NO: 8955 - DNA, 601 bp, Human
tccaatccattgtagtgatgtatctattccaaaggcgatgaaagtaaataagacttttttggtaaaagtactttttttttttttttttggtaataagtaagacaaagtacctgctcaaaattatcagcaaaatcaataattttaaagcaagggaaaaataatgcatagtccttactttctaatcagtcctcggcccctcagtttagttcagtaatgattaatatcatcatgatcatgaccatcatcatccactaggttccaggctctgtgctaaatgccagagtacaaatgtaaagaagamagggcctgggcccctgaggggctctgcctagttaactctagggtacatgttggtgccctaattgtgataggtttgacctctagatttcttctagggctacaattagaacacactgtcaatctggaatgagaaccaaccaatgtaagtatctaaaaattgcccaagatgctataacacttgtgctaggtatagcagggtgactgattttctaacaatattgaacctatctgtaaacaatcaatgtttcacacctagatttattttaacacatactgggcttaaaaaattattgtatatact

SEQ ID NO: 8956 - DNA, 601 bp, Human
ccctaaaacttaaagtataataaaaaaaaatctcccaaaggccccacctgctaatgccatcacactggaggttagatttcagtatgtgaatttttggaggacacaaacttccaatccattgtagtgatgtatctattccaaaggcgatgaaagtaaataagacttttttggtaaaagtactttttttttttttttttggtaataagtaagacaaagtacctgctcaaaattatcagcaaaatcaataattttaaagcaagggaaaaataatgcatagtccttactttctaatcagtcctcrgcccctcagtttagttcagtaatgattaatatcatcatgatcatgaccatcatcatccactaggttccaggctctgtgctaaatgccagagtacaaatgtaaagaagacagggcctgggcccctgaggggctctgcctagttaactctagggtacatgttggtgccctaattgtgataggtttgacctctagatttcttctagggctacaattagaacacactgtcaatctggaatgagaaccaaccaatgtaagtatctaaaaattgcccaagatgctataacacttgtgctaggtata

SEQ ID NO: 8957 - DNA, 601 bp, Human
ccaggttgtagactgccatcttctccttgtatcctcacatggtagaaagagggtgagtgagagggtcccttttataagggcactaatctcatcatgagggctccatcctcattacctaaaaatctcccaaaggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaatctcccaaaggccccacctrctaatgccatcacactggaggttagatttcagtatgtgaatttttggaggacacaaacttccaatccattgtagtgatgtatctattccaaaggcgatgaaagtaaataagacttttttggtaaaagtactttttttttttttttttggtaataagtaagacaaagtacctgctcaaaattatcagcaaaatcaataattttaaagcaagggaaaaataatgcatagtccttactttctaatcagtcctcggcccctcagtttagttcagtaatgattaatatcatcatgatcatgacca

SEQ ID NO: 8958 - DNA, 601 bp, Human
atggttgggttctggtgcagggtctcttccaggttgtagactgccatcttctccttgtatcctcacatggtagaaagagggtgagtgagagggtcccttttataagggcactaatctcatcatgagggctccatcctcattacctaaaaatctcccaaaggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaatctcccaaaggccccacctgctaatgccatcacactggaggttagatttcagtatgtgaatttttggaggacacaaacttccaatccattgtagtgatgtatctattccaaaggcgatgaaagtaaataagacttttttggtaaaagtactttttttttttttttttggtaataagtaagacaaagtacctgctcaaaattatcagcaaaatcaataattttaaagcaagggaaaaataatgcatagtccttactttctaatcagtcctcggcccctcagtttagttcagta

SEQ ID NO: 8959 - DNA, 601 bp, Human
tggtgattttcttagtttgggttgctgttaacaaagtaccctggattgagtggcttataaacaacggacacttcttcctcacagttctggaggctggaagtttaaaatcagggtgccagcatggttgggttctggtgcagggtctcttccaggttgtagactgccatcttctccttgtatcctcacatggtagaaagagggtgagtgagagggtcccttttataagggcactaatctcatcatgagggctccatcctcattacctaaaaatctcccaaaggaggggggagggatagcattkggagatatacctaatgctagatgacgagttagtgggtgcagcgcaccagcatggcacatgtatacatatgtaactaacctgcacaatgtgcacatgtaccctaaaacttaaagtataataaaaaaaaatctcccaaaggccccacctgctaatgccatcacactggaggttagatttcagtatgtgaatttttggaggacacaaacttccaatccattgtagtgatgtatctattccaaaggcgatgaaagtaaataagacttttttggtaaaagtactttttttttttttttttggtaa

SEQ ID NO: 8960 - DNA, 601 bp, Human
gtgagtaagatagaaattggtgattttcttagtttgggttgctgttaacaaagtaccctggattgagtggcttataaacaacggacacttcttcctcacagttctggaggctggaagtttaaaatcagggtgccagcatggttgggttctggtgcagggtctcttccaggttgtagactgccatcttctccttgtatcctcacatggtagaaagagggtgagtgagagggtcccttttataagggcactaatctcatcatgagggctccatcctcattacctaaaaatctcccaaaggagsggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaatctcccaaaggccccacctgctaatgccatcacactggaggttagatttcagtatgtgaatttttggaggacacaaacttccaatccattgtagtgatgtatctattccaaaggcgatgaaagtaaataagacttttttggtaaaagtacttttt

SEQ ID NO: 8961 - DNA, 601 bp, Human
tttagataagatagatcttaagtgtgcttgagttctggtaacacatgtgagtaagatagaaattggtgattttcttagtttgggttgctgttaacaaagtaccctggattgagtggcttataaacaacggacacttcttcctcacagttctggaggctggaagtttaaaatcagggtgccagcatggttgggttctggtgcagggtctcttccaggttgtagactgccatcttctccttgtatcctcacatggtagaaagagggtgagtgagagggtcccttttataagggcactaatctyatcatgagggctccatcctcattacctaaaaatctcccaaaggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaatctcccaaaggccccacctgctaatgccatcacactggaggttagatttcagtatgtgaatttttggaggacacaaacttccaatccattgtagtgatgtatctattcc

SEQ ID NO: 8962 - DNA, 601 bp, Human
atgctctgatagcctgtgggaatacatgttcacattttggttaagtattttctttcccagtcatgttgcaattaatacagcctctttcctttatgttctactttagataagatagatcttaagtgtgcttgagttctggtaacacatgtgagtaagatagaaattggtgattttcttagtttgggttgctgttaacaaagtaccctggattgagtggcttataaacaacggacacttcttcctcacagttctggaggctggaagtttaaaatcagggtgccagcatggttgggttctggtrcagggtctcttccaggttgtagactgccatcttctccttgtatcctcacatggtagaaagagggtgagtgagagggtcccttttataagggcactaatctcatcatgagggctccatcctcattacctaaaaatctcccaaaggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaatctcccaa

SEQ ID NO: 8963 - DNA, 601 bp, Human
atttaagataatataatcctttttctagagataactttatcctttttgatgggttatgaagactggaaaatatttgtaaaatttctggctcctaacaaatgctctgatagcctgtgggaatacatgttcacattttggttaagtattttctttcccagtcatgttgcaattaatacagcctctttcctttatgttctactttagataagatagatcttaagtgtgcttgagttctggtaacacatgtgagtaagatagaaattggtgattttcttagtttgggttgctgttaacaaagtamcctggattgagtggcttataaacaacggacacttcttcctcacagttctggaggctggaagtttaaaatcagggtgccagcatggttgggttctggtgcagggtctcttccaggttgtagactgccatcttctccttgtatcctcacatggtagaaagagggtgagtgagagggtcccttttataagggcactaatctcatcatgagggctccatcctcattacctaaaaatctcccaaaggaggggggagggatagcattgggagatatacctaatgctagatgacgagttagtgggtg

SEQ ID NO: 8964 - DNA, 601 bp, Human
gatacctgtttgtttgttgttggttttttgacagcactcatcgccatttgtaattcagtatttgtgagactatatggttaacgatacttttttctgctagatagtgggagaaagcacttgaacttcagggtcagagttgaaaatatcttggtggttgtatcatttgctaactgtgggaacttgggaaggtttcttgaagtccctttaacctcagttttttcatttataatttaagataatataatcctttttctagagataactttatcctttttgatgggttatgaagactggaaaatakttgtaaaatttctggctcctaacaaatgctctgatagcctgtgggaatacatgttcacattttggttaagtattttctttcccagtcatgttgcaattaatacagcctctttcctttatgttctactttagataagatagatcttaagtgtgcttgagttctggtaacacatgtgagtaagatagaaattggtgattttcttagtttgggttgctgttaacaaagtaccctggattgagtggcttataaacaacggacacttcttcctcacagttctggaggctggaagtttaaaatcag

SEQ ID NO: 8965 - DNA, 601 bp, Human
ctgccttcacaagctcccctaagggcaaaacattatattctttgcagggtaggagataacttttgaagttcttcctccctttatttttctgggtaaatgtgtgctcattcttcagatgtcagatcaaatatcatcttacacccttcttgatctctgattgtgatacctgtttgtttgttgttggttttttgacagcactcatcgccatttgtaattcagtatttgtgagactatatggttaacgatacttttttctgctagatagtgggagaaagcacttgaacttcagggtcagagttgaaaatatcttggtggttgtatcatttgctaactgtgggaacttgggaaggtttcttgaagtccctttaacctcagttttttcatttataatttaagataatataatcctttttctagagataactttatcctttttgatgggttatgaagactggaaaatatttgtaaaatttctggctcctaacaaatgctctgatagcctgtgggaatacatgttcacattttggttaagtattttctttcccagtcatgttgcaattaatacagcctctttcctttatgttctactttagataagata

SEQ ID NO: 8966 - DNA, 601 bp, Human
gtttctggacaggcagcttccactgtttcaactgttaaaacatcacatggggtttctatagtagaaaatgatattctttccactgccttcacaagctcccctaagggcaaaacattatattctttgcagggtaggagataacttttgaagttcttcctccctttatttttctgggtaaatgtgtgctcattcttcagatgtcagatcaaatatcatcttacacccttcttgatctctgattgtgatacctgtttgtttgttgttggttttttgacagcactcatcgccatttgtaattcartatttgtgagactatatggttaacgatacttttttctgctagatagtgggagaaagcacttgaacttcagggtcagagttgaaaatatcttggtggttgtatcatttgctaactgtgggaacttgggaaggtttcttgaagtccctttaacctcagttttttcatttataatttaagataatataatcctttttctagagataactttatcctttttgatgggttatgaagactggaaaatatttgtaaaatttctggctcctaacaaatgctctgatagcctgtgggaatacatgttca

SEQ ID NO: 8967 - DNA, 601 bp, Human
taaagttgaaaaatgatgtttctggacaggcagcttccactgtttcaactgttaaaacatcacatggggtttctatagtagaaaatgatattctttccactgccttcacaagctcccctaagggcaaaacattatattctttgcagggtaggagataacttttgaagttcttcctccctttatttttctgggtaaatgtgtgctcattcttcagatgtcagatcaaatatcatcttacacccttcttgatctctgattgtgatacctgtttgtttgttgttggttttttgacagcactcakcgccatttgtaattcagtatttgtgagactatatggttaacgatacttttttctgctagatagtgggagaaagcacttgaacttcagggtcagagttgaaaatatcttggtggttgtatcatttgctaactgtgggaacttgggaaggtttcttgaagtccctttaacctcagttttttcatttataatttaagataatataatcctttttctagagataactttatcctttttgatgggttatgaagactggaaaatatttgtaaaatttctggctcctaacaaatgctctgatagcct

SEQ ID NO: 8968 - DNA, 601 bp, Human
cctcaaggaaaagtgctggattgtatttgtcttagtgtctctggtgccttccataggtacctagagaagcatggaacatgaacatgaagaagatgctcagtgaatatttattaaactcctaaaatttaaggtcctatgggctacagcctaggtcaacaagtcaaagctcatggctgtgtgttgttatgattgcgtaatgttaaaatagattaaatgccaacattaaacatccggagaaattatataagaatttggattactggtttctctttaaaaaacaaaaacctggagatctggttarcaacaggaccaaactcctgcacagaattttgttggatctggatcttagctgcccttttctgctttctgatgatcagttcttactggaccaattttgttcactgaactacttatctggctactataggcatctgagtttgtgaactttgcgctagcataaagtggactttgttgtgtcttcccccaacacaccccaaaggatagcttgacactaataactaatatttactctaggctgtactttcactttgataataaaactgtcaagagctgagaaatgataaaagcttaagtcacttcc

SEQ ID NO: 8969 - DNA, 601 bp, Human
tacttctctcttcagtcttatcatacgtcttttctcttgtttactatgggctccttgtcccttgggtcccctgtcagttccccagacatccaagttctgtcctacctcagggtctttgcagatgccattccctctgcctagagtgctcttcctcccgtcttccttttgataaatatgtgctcatcattcagacatcaccttgaatatctgttcacttctacctttatctccaattctgatacacatttttttcttttacagcacccatcacaatttgtaattaaatgcctgtgagattatrtgactaattcattttcttctactagatcataagtatttgtgtcctgcacattttggtcacccaagtgtgagttcctcaaggaaaagtgctggattgtatttgtcttagtgtctctggtgccttccataggtacctagagaagcatggaacatgaacatgaagaagatgctcagtgaatatttattaaactcctaaaatttaaggtcctatgggctacagcctaggtcaacaagtcaaagctcatggctgtgtgttgttatgattgcgtaatgttaaaatagattaaatgccaacattaaa

SEQ ID NO: 8970 - DNA, 601 bp, Human
tttctctgtgattatactgtcctctgcaggactctgccctaaaatcacaaattctagccatttgagcttctccgaagtccaaactctatttcctcaacccatagagactctgtctgggttctccctgcttgtgctgttccctggaaacactcttcaagcagtaagcttaggtgctcatagggcacatctggtttgttactcttcttttactgtcttgagttgtctgtcattcgatgtctgaaaacttctgttttatatgttttgtctgcctgtctagttgttgagaaaaagggtaaatctkgttccttatgttctgaagccaaagtctgagatgctaaatttccatataaaatatttttttacattacagcaatgtcagcttcccttctttaattgtacctttccccatcccaactgtggaaaatctattccactcaaaacgctttgcatgagtttgcatggcatcagcatatgtttggattctccaggtgggagtggaaaataaggcacatccattcaatagcaatgaaggattcaggtactacagtaacgtgcaatgtatctcatgaggttctgagcatggaaaccataagttgagtag

SEQ ID NO: 8971 - DNA, 601 bp, Human
ttctcaatctgttgagttttttcttggttatgagtcatctctttctgcttcttctaatgcttgtttatttttattaacattgtgaatttacattgttgtttgttgcattcttgttaactagtattgagttttattcacagttaagatacttgaaatcaaatcttgttttttattctgttgcctcctcagcagcctgtagtctaattttatccacccactgtttctaaatccttctgacaattctatccagtgctcatttattaggaggtctttctatgtttgatggtaggaacataaacgmttaccggccctgagtaaggtccagggactgttccacctgttcctttcaagtgacatttttcttaccctcagtactttcctcacatgtatgtgcagatcagtattcaacttgacaaaacctctctgtagattctctagagctctttctctgtgattatactgtcctctgcaggactctgccctaaaatcacaaattctagccatttgagcttctccgaagtccaaactctatttcctcaacccatagagactctgtctgggttctccctgcttgtgctgttccctggaaacactcttcaag

SEQ ID NO: 8972 - DNA, 601 bp, Human
acaattgtattcatctacagaagttctgtgtatgcatatttatattctctatcttcatcatgctcatgcttttctctgctttctggaacatattgagaagatttatgatagctgtcttactgtctctgcctgctgcttctattctctctttcacttctcaatctgttgagttttttcttggttatgagtcatctctttctgcttcttctaatgcttgtttatttttattaacattgtgaatttacattgttgtttgttgcattcttgttaactagtattgagttttattcacagttaagayacttgaaatcaaatcttgttttttattctgttgcctcctcagcagcctgtagtctaattttatccacccactgtttctaaatccttctgacaattctatccagtgctcatttattaggaggtctttctatgtttgatggtaggaacataaacgattaccggccctgagtaaggtccagggactgttccacctgttcctttcaagtgacatttttcttaccctcagtactttcctcacatgtatgtgcagatcagtattcaacttgacaaaacctctctgtagattctctagagctctttc

SEQ ID NO: 8973 - DNA, 601 bp, Human
ctttgttttcttagtggtgcccttccgtttacaatatatagtacatttttaacttgtcacaaacttccttcaaataatattatactatttcacttgtaagaaccttgcaataatatatttccatttcttccctcccagcctttgtgctattgtcatacattttatttatatatacataatataccccacaataaattgttactattttgctttaacatttagataatcaattgcctttttaatagattaaaacgaggaaaaaatttctctatatttatcaacttctggaacttttcattcyttcttatgaatctaaatgtctctctgacataatatttcttctatctaaaggagttcctttaacatttttttctgctctgttagtgagaaattctttctgcatttgtatgtctaaaacactctttattttgccttcatttaaaaaagactttttgacttggtatagaatactaaacagacagattcccctatcttctaccctcccaacactttaaagatgtccctaattgtcttctggtgtgcatagtttctaacgataagtctgctatcatttcttggttttgttcccctgtatgtggtg

SEQ ID NO: 8974 - DNA, 601 bp, Human
ggattgagtatagttagtgatgtttaatctccattgttgccttcttagctttgttttcttagtggtgcccttccgtttacaatatatagtacatttttaacttgtcacaaacttccttcaaataatattatactatttcacttgtaagaaccttgcaataatatatttccatttcttccctcccagcctttgtgctattgtcatacattttatttatatatacataatataccccacaataaattgttactattttgctttaacatttagataatcaattgcctttttaatagattaaaaygaggaaaaaatttctctatatttatcaacttctggaacttttcattccttcttatgaatctaaatgtctctctgacataatatttcttctatctaaaggagttcctttaacatttttttctgctctgttagtgagaaattctttctgcatttgtatgtctaaaacactctttattttgccttcatttaaaaaagactttttgacttggtatagaatactaaacagacagattcccctatcttctaccctcccaacactttaaagatgtccctaattgtcttctggtgtgcatagtttcta

SEQ ID NO: 8975 - DNA, 601 bp, Human
tacccagtcttatagctatagttccaatcaagatagagaagagttccatcattccaaaacatttcttcatgccatttgtagccaatgccctctgggcccagacaaccactaatctgctttatttcactataatttggcttttctgtaatgtcatatcaatggaatcatcattacacacccttttgtgttggattagtgttagctggtatggtatataattttctatcctttattttttacctatctttgtctctctcattaaagtggatttcttaaattctgcatacagtttagcattgcttttttattcaatcttatttgtttcttaattgtagtgttctttccatttacttttaatgtaattgatgatatggttgaatttaaaactgccatctttatatttattttctatttgtctatctggtctttattccttttccccttcctttctgttttcttttggattgagtatagttagtgatgtttaatctccattgttgccttcttagctttgttttcttagtggtgcccttccgtttacaatatatagtacatttttaacttgtcacaaacttccttcaaataatattatactatttca

SEQ ID NO: 8976 - DNA, 601 bp, Human
ccttcctttctcttccctttcttttctttttcctttcctagtttcttttcttttctcctttcttcctttctttgtcttcttccttccctattccccaccctccttccctctctttcttcctttcattatcctcattgaggtataatttgcatataataacatttaccacttttaagtataatatttgctgagctttgattaaaacaattacccagtcttatagctatagttccaatcaagatagagaagagttccatcattccaaaacatttcttcatgccatttgtagccaatgccctcygggcccagacaaccactaatctgctttatttcactataatttggcttttctgtaatgtcatatcaatggaatcatcattacacacccttttgtgttggattagtgttagctggtatggtatataattttctatcctttattttttacctatctttgtctctctcattaaagtggatttcttaaattctgcatacagtttagcattgcttttttattcaatcttatttgtttcttaattgtagtgttctttccatttacttttaatgtaattgatgatatggttgaatttaaaactgccat

SEQ ID NO: 8977 - DNA, 601 bp, Human
gagagccaagtggaatgaacagtttcctctgcctgaggaattcctcatttaattaggtgaaagattccctatcatcagctggtgacagaatttctctttgggatgcagttatttttgtttggtacaataacttgataaattctttacgagaagaaggtgagaacatcagtgtggatgtaggcagacaacaaggatctggggaaaaaagcctgaaatgttttacatgatggggtaaaaggccaataaaactcctcttactgaagcaactacactttttgaaaactgaaatgattaatccttyccctccccttcctttctcttccctttcttttctttttcctttcctagtttcttttcttttctcctttcttcctttctttgtcttcttccttccctattccccaccctccttccctctctttcttcctttcattatcctcattgaggtataatttgcatataataacatttaccacttttaagtataatatttgctgagctttgattaaaacaattacccagtcttatagctatagttccaatcaagatagagaagagttccatcattccaaaacatttcttcatgccatttgtagccaat

SEQ ID NO: 8978 - DNA, 601 bp, Human
ataataaaatggagcaagtgaggtcaggaaggggagaggtgagtgccatagagagccaagtggaatgaacagtttcctctgcctgaggaattcctcatttaattaggtgaaagattccctatcatcagctggtgacagaatttctctttgggatgcagttatttttgtttggtacaataacttgataaattctttacgagaagaaggtgagaacatcagtgtggatgtaggcagacaacaaggatctggggaaaaaagcctgaaatgttttacatgatggggtaaaaggccaataaaactmctcttactgaagcaactacactttttgaaaactgaaatgattaatcctttccctccccttcctttctcttccctttcttttctttttcctttcctagtttcttttcttttctcctttcttcctttctttgtcttcttccttccctattccccaccctccttccctctctttcttcctttcattatcctcattgaggtataatttgcatataataacatttaccacttttaagtataatatttgctgagctttgattaaaacaattacccagtcttatagctatagttccaatcaagatag

SEQ ID NO: 8979 - DNA, 601 bp, Human
ctgagatactcaatattaaaagaagtgtagagggttgggtgaggttttcaataataaaatggagcaagtgaggtcaggaaggggagaggtgagtgccatagagagccaagtggaatgaacagtttcctctgcctgaggaattcctcatttaattaggtgaaagattccctatcatcagctggtgacagaatttctctttgggatgcagttatttttgtttggtacaataacttgataaattctttacgagaagaaggtgagaacatcagtgtggatgtaggcagacaacaaggatctgggraaaaaagcctgaaatgttttacatgatggggtaaaaggccaataaaactcctcttactgaagcaactacactttttgaaaactgaaatgattaatcctttccctccccttcctttctcttccctttcttttctttttcctttcctagtttcttttcttttctcctttcttcctttctttgtcttcttccttccctattccccaccctccttccctctctttcttcctttcattatcctcattgaggtataatttgcatataataacatttaccacttttaagtataatatttgctgagct

SEQ ID NO: 8980 - DNA, 601 bp, Human
taatcagagaattgaatcgcctttgattagtaaaccatctcagaatataagaatgggtgatatcttctttgtggtgtttaataagacatacttagcctattaacatgagatgggaggatagtcagagctgtttatgtattattttgttttgctatttcagatcttctttccaactgctgtgatcctcagctttgttttatctctttatttcatcttagccatctgattatctcaattttttcccccgagccacagcgtctaactcccctatgcaggctggttgtctgtatgaatatgaaaygtgtccatcccctgaaacttagatgtcttactttgtactttgtgcacccaaagacacatcattaacacctccatgtatattggactttccctactgataggagagggagaggatgaagaaattggtcttctttattgaagagaaggaactgagatactcaatattaaaagaagtgtagagggttgggtgaggttttcaataataaaatggagcaagtgaggtcaggaaggggagaggtgagtgccatagagagccaagtggaatgaacagtttcctctgcctgaggaattcctcatttaa

SEQ ID NO: 8981 - DNA, 601 bp, Human
ccactctcaaatctggggatagctaagatgagttctctggagatgcatatgtccttcaatagtgaacttttattatttggaaagattcacatatgcccatttctatgctcatgtacttacaaaggctttgataacatggtgatcttaagaataacaaatgttatttgtaaattaaagtttagcaagttaattttccagggtacctgaacaattattatttaaatataatcagagaattgaatcgcctttgattagtaaaccatctcagaatataagaatgggtgatatcttctttgtggtstttaataagacatacttagcctattaacatgagatgggaggatagtcagagctgtttatgtattattttgttttgctatttcagatcttctttccaactgctgtgatcctcagctttgttttatctctttatttcatcttagccatctgattatctcaattttttcccccgagccacagcgtctaactcccctatgcaggctggttgtctgtatgaatatgaaatgtgtccatcccctgaaacttagatgtcttactttgtactttgtgcacccaaagacacatcattaacacctccatg

SEQ ID NO: 8982 - DNA, 601 bp, Human; identical to SEQ ID NO: 1043

SEQ ID NO: 8983 - DNA, 601 bp, Human; identical to SEQ ID NO: 1044

SEQ ID NO: 8984 - DNA, 601 bp, Human; identical to SEQ ID NO: 1045

SEQ ID NO: 8985 - DNA, 601 bp, Human; identical to SEQ ID NO: 1046

SEQ ID NO: 8986 - DNA, 601 bp, Human; identical to SEQ ID NO: 1047

SEQ ID NO: 8987 - DNA, 601 bp, Human; identical to SEQ ID NO: 1048

SEQ ID NO: 8988 - DNA, 601 bp, Human; identical to SEQ ID NO: 1049

SEQ ID NO: 8989 - DNA, 601 bp, Human; identical to SEQ ID NO: 1050

SEQ ID NO: 8990 - DNA, 601 bp, Human; identical to SEQ ID NO: 1051

SEQ ID NO: 8991 - DNA, 601 bp, Human; identical to SEQ ID NO: 1052

SEQ ID NO: 8992 - DNA, 601 bp, Human; identical to SEQ ID NO: 1053

SEQ ID NO: 8993 - DNA, 601 bp, Human; identical to SEQ ID NO: 1054

SEQ ID NO: 8994 - DNA, 601 bp, Human; identical to SEQ ID NO: 1055

SEQ ID NO: 8995 - DNA, 601 bp, Human; identical to SEQ ID NO: 1056

SEQ ID NO: 8996 - DNA, 601 bp, Human; identical to SEQ ID NO: 1057

SEQ ID NO: 8997 - DNA, 601 bp, Human; identical to SEQ ID NO: 1058

SEQ ID NO: 8998 - DNA, 601 bp, Human; identical to SEQ ID NO: 1059

SEQ ID NO: 8999 - DNA, 601 bp, Human; identical to SEQ ID NO: 1060

SEQ ID NO: 9000 - DNA, 601 bp, Human; identical to SEQ ID NO: 1061

SEQ ID NO: 9001 - DNA, 601 bp, Human; identical to SEQ ID NO: 1062

SEQ ID NO: 9002 - DNA, 601 bp, Human; identical to SEQ ID NO: 1063

SEQ ID NO: 9003 - DNA, 601 bp, Human; identical to SEQ ID NO: 1064

SEQ ID NO: 9004 - DNA, 601 bp, Human; identical to SEQ ID NO: 1065

SEQ ID NO: 9005 - DNA, 601 bp, Human; identical to SEQ ID NO: 1066

SEQ ID NO: 9006 - DNA, 601 bp, Human; identical to SEQ ID NO: 1067

SEQ ID NO: 9007 - DNA, 601 bp, Human; identical to SEQ ID NO: 1068

SEQ ID NO: 9008 - DNA, 601 bp, Human; identical to SEQ ID NO: 1069

SEQ ID NO: 9009 - DNA, 601 bp, Human; identical to SEQ ID NO: 1070

SEQ ID NO: 9010 - DNA, 601 bp, Human; identical to SEQ ID NO: 1071

SEQ ID NO: 9011 - DNA, 601 bp, Human; identical to SEQ ID NO: 1072

SEQ ID NO: 9012 - DNA, 601 bp, Human; identical to SEQ ID NO: 1073

SEQ ID NO: 9013 - DNA, 601 bp, Human; identical to SEQ ID NO: 1074

SEQ ID NO: 9014 - DNA, 601 bp, Human; identical to SEQ ID NO: 1075

SEQ ID NO: 9015 - DNA, 601 bp, Human; identical to SEQ ID NO: 1076

SEQ ID NO: 9016 - DNA, 601 bp, Human; identical to SEQ ID NO: 1077

SEQ ID NO: 9017 - DNA, 601 bp, Human; identical to SEQ ID NO: 1078

SEQ ID NO: 9018 - DNA, 601 bp, Human; identical to SEQ ID NO: 1079

SEQ ID NO: 9019 - DNA, 601 bp, Human; identical to SEQ ID NO: 1080

SEQ ID NO: 9020 - DNA, 601 bp, Human; identical to SEQ ID NO: 1081

SEQ ID NO: 9021 - DNA, 601 bp, Human; identical to SEQ ID NO: 1082

SEQ ID NO: 9022 - DNA, 601 bp, Human; identical to SEQ ID NO: 1083

SEQ ID NO: 9023 - DNA, 601 bp, Human; identical to SEQ ID NO: 1084

SEQ ID NO: 9024 - DNA, 601 bp, Human; identical to SEQ ID NO: 1085

SEQ ID NO: 9025 - DNA, 601 bp, Human; identical to SEQ ID NO: 1086

SEQ ID NO: 9026 - DNA, 601 bp, Human; identical to SEQ ID NO: 1087

SEQ ID NO: 9027 - DNA, 601 bp, Human; identical to SEQ ID NO: 1088

SEQ ID NO: 9028 - DNA, 601 bp, Human; identical to SEQ ID NO: 1089

SEQ ID NO: 9029 - DNA, 601 bp, Human; identical to SEQ ID NO: 1090

SEQ ID NO: 9030 - DNA, 601 bp, Human; identical to SEQ ID NO: 1091

SEQ ID NO: 9031 - DNA, 601 bp, Human; identical to SEQ ID NO: 1092

SEQ ID NO: 9032 - DNA, 601 bp, Human; identical to SEQ ID NO: 1093

SEQ ID NO: 9033 - DNA, 601 bp, Human; identical to SEQ ID NO: 1094

SEQ ID NO: 9034 - DNA, 601 bp, Human; identical to SEQ ID NO: 1095

SEQ ID NO: 9035 - DNA, 601 bp, Human; identical to SEQ ID NO: 1096

SEQ ID NO: 9036 - DNA, 601 bp, Human; identical to SEQ ID NO: 1097

SEQ ID NO: 9037 - DNA, 601 bp, Human; identical to SEQ ID NO: 1098

SEQ ID NO: 9038 - DNA, 601 bp, Human; identical to SEQ ID NO: 2204

SEQ ID NO: 9039 - DNA, 601 bp, Human; identical to SEQ ID NO: 2205

SEQ ID NO: 9040 - DNA, 601 bp, Human; identical to SEQ ID NO: 2206

SEQ ID NO: 9041 - DNA, 601 bp, Human; identical to SEQ ID NO: 2207

SEQ ID NO: 9042 - DNA, 601 bp, Human; identical to SEQ ID NO: 2208

SEQ ID NO: 9043 - DNA, 601 bp, Human; identical to SEQ ID NO: 2209

SEQ ID NO: 9044 - DNA, 601 bp, Human; identical to SEQ ID NO: 2210

SEQ ID NO: 9045 - DNA, 601 bp, Human; identical to SEQ ID NO: 2211

SEQ ID NO: 9046 - DNA, 601 bp, Human
cggaggctctctggtactgcttttccaccccagctggggtccgtccctcagaagaacaggactcggcctcgagaccctcccccttcgtcctgctccagtcgggccggctttcgacaaagcggccggagcgccaggccagcctcctgccccgccccgccccgcgcggttctacgggcgcccaggtgtggtgggcggggccaggcgcagctgctgcgcccccccacccggggtccggcagtgttccgctctcgcaggctcttcagtcccctggttcccaggagcggcggcggcggcggcggcrgcggcagcgcccggcgagctctccggaagccaagtggcggcggctggaaggaggccgcgcggccgctggggtgcgctgtgtgccaagccgacttctggggagcgcgctaggtgactgggtgtgttctcagagtgccccagggagggaaggtcgcgatgtgggaagttttgcccgaaagtaagagatgatgagaccctgggcccttttcctggggcctgggagtgcaatgaccttcccgcctagcttttccctagccctacgcttgggtctgggaggagcgggaccgacctccttcagagc

SEQ ID NO: 9047 - DNA, 601 bp, Human
gatggcctcagaggggcaggtgacccctgaaaactgttagtcgacagcaaccgatcattctagacctccatggccttagtgtctcacgctaaactcgcaaaaaatgccctttcagggctatcctctgggcgctcaagatttaggattttgaaggaagaaggtgaaagcgggggaagacgattttaaaagaagggctgggttattaaagagaaaagattaatcccggagccttcccctctgtcaaaaaaccctgaaagtgactaaattgacaccaactctggatgttccttaggaaaaaaaaaaaacaaaacaaaacaaaacaagattaaaaagggcccaatttaagacccttattaatacatctgcaagagagcaaagaataacaacaacaacaaaagttatacagtcaattttcaatgatacatcgtcccactggtgccaccggggcgccaccacccagcacccgagacccgccgcgcccccggaaaaagtgggaagggacgtagggggatgctgaaggaagtaccttgttttgtctccaaagggcaacatagcaaacgtgggaagttcgttttcgaactccgccgatcctggactccag

SEQ ID NO: 9048 - DNA, 601 bp, Human
accttgatgttcaataactaccattgagtgtagatcatttagtctgagaaaaggatggaaaatcatgcatgaatgtcgaatgacaacaataatgcagaaattgtttttatcagcaagcctgattactggtgcagatggacgatctgggtgaatataaatatattttaaatcttaaaacatgccgcatgcatctacagaactattttgtttcatgggtttcctgaatcacatacaatattcattttacacttacaaagtgtaaaaagaggggaaaagcaaagtaatgtgagctcctactttwaaaaaaaaaaatccttagctgtaaagttaaaacgtatgcaataagtttttaccacaaaatgtgaaccacactggggttagtggtttgcatttttataatcaacaaatgtccatcctcttattcacattttaagtctcctgttaatgccaccaaatataaaaccaaattggaatattgtttcatgaaagacctctggctacacacaaattcttaggttatattctttactctgacaactctcagcactttattataactcttaaaattgaggacctgcactattaaatattttacactttc

SEQ ID NO: 9049 - DNA, 601 bp, Human
agtcaggctggtcttgaactcctgacgtcgtgatctgcccgcctcggcctcccaaagtgctgggattacaggcatgagccaccgtgccaggcccaacctatagcttttaataagatgcgtagctctctacttgaagacagtgatagtaaacaatgtaatataatggcataaatgctttcaaggtcaacccaaattcacaggtgtttgagaatttaggaatgccagaaccttgatgttcaataactaccattgagtgtagatcatttagtctgagaaaaggatggaaaatcatgcatgaatrtcgaatgacaacaataatgcagaaattgtttttatcagcaagcctgattactggtgcagatggacgatctgggtgaatataaatatattttaaatcttaaaacatgccgcatgcatctacagaactattttgtttcatgggtttcctgaatcacatacaatattcattttacacttacaaagtgtaaaaagaggggaaaagcaaagtaatgtgagctcctacttttaaaaaaaaaaatccttagctgtaaagttaaaacgtatgcaataagtttttaccacaaaatgtgaaccacactgg

SEQ ID NO: 9050 - DNA, 601 bp, Human
ccttcaggactgcaaattgtctacaatagtgacctgggagttttccagatgtgatttattggcctcaaattaatttttatgccaaccgactatgttctgaatcattcaattgacaccttcaaatggacataaacaggttgtgataactaaaaagctccaagttatagctttttttttttttttttgagatggagtctcactctgttgcccaggctggagtatagtggagcaatcttggctcactgcaacctctgcctcccgggttcaagcgattctccttagtagctgggattacaggcgygcgccatgcctggctaatttttgtatttttagtagagacggggtttcaccatgttggtcagtcaggctggtcttgaactcctgacgtcgtgatctgcccgcctcggcctcccaaagtgctgggattacaggcatgagccaccgtgccaggcccaacctatagcttttaataagatgcgtagctctctacttgaagacagtgatagtaaacaatgtaatataatggcataaatgctttcaaggtcaacccaaattcacaggtgtttgagaatttaggaatgccagaaccttgatgttcaat

SEQ ID NO: 9051 - DNA, 601 bp, Human
taatcagataagggcgaagctacaagctttacctatacaaccttaacagaattccaaatatttcaaaagaaataatacttgagaccagagtcaaatcatttatttaagcagaataatttaaaaaggaaatttggttgcatagcataatcaaaatactaaaaatttcctcatcttgaggtgctgaggacataaacgtgtgaaaatattgacaatttctacagatcatcagatgacagactgaaaaaaagctactgaatgataccacaagcctatttaagtttgtgttatactaagcaaatckatttatttgaagatatccatctacactaattgccattgcattaattctaccacatttttaggaatcatgtagtttaggctctaacatgggtctgaatttgaaactttgaaaacactagagatagaagagcaatgagaaacattatttcaggggctcctatggatttctccaggcaggaagaatgcaatccagaagagtgcttcaaggacactaaaagcagcttagagctggttatatggaccctggttatgaacaacataagaaaaaaaggccattattgcaccagaattaccattataa

SEQ ID NO: 9052 - DNA, 601 bp, Human
ttggctgttggaacaaagaacaaatatagcttgacacagcaattataggtttaacttctaagttaatttgtattttcaaatctagaggaaggggtgcctcaaagtaggacacactccctataatcagataagggcgaagctacaagctttacctatacaaccttaacagaattccaaatatttcaaaagaaataatacttgagaccagagtcaaatcatttatttaagcagaataatttaaaaaggaaatttggttgcatagcataatcaaaatactaaaaatttcctcatcttgaggtgytgaggacataaacgtgtgaaaatattgacaatttctacagatcatcagatgacagactgaaaaaaagctactgaatgataccacaagcctatttaagtttgtgttatactaagcaaatcgatttatttgaagatatccatctacactaattgccattgcattaattctaccacatttttaggaatcatgtagtttaggctctaacatgggtctgaatttgaaactttgaaaacactagagatagaagagcaatgagaaacattatttcaggggctcctatggatttctccaggcaggaag

SEQ ID NO: 9053 - DNA, 601 bp, Human
tttcaacccttcactatcaatcaactcattgatttatttaattgtcctacagtccttactaaaggtttttttatcctaggaagaggtttttatcccacaattggctgttggaacaaagaacaaatatagcttgacacagcaattataggtttaacttctaagttaatttgtattttcaaatctagaggaaggggtgcctcaaagtaggacacactccctataatcagataagggcgaagctacaagctttacctatacaaccttaacagaattccaaatatttcaaaagaaataatacttsagaccagagtcaaatcatttatttaagcagaataatttaaaaaggaaatttggttgcatagcataatcaaaatactaaaaatttcctcatcttgaggtgctgaggacataaacgtgtgaaaatattgacaatttctacagatcatcagatgacagactgaaaaaaagctactgaatgataccacaagcctatttaagtttgtgttatactaagcaaatcgatttatttgaagatatccatctacactaattgccattgcattaattctaccacatttttaggaatcatgtagtttaggct

SEQ ID NO: 9054 - DNA, 601 bp, Human
ttaaaagctttaaaggccgggtgcggtggctcacgcctgtaatcccagcactttgagaggccgaggtgggtggaccacgaggtcaggagatcgagaccatcctggctaacatggtgaaaccccgtctctactaaaaatataaaaaattagctgggtgtggtggtgggcacctgtggtcccagctactcgggagtctgaggcaggagaatggcgtaaactcggcttgcaatgagccgagattgcgccactgcactccagcctgggtaacagagcaatactccgtctcgaaaaaaaaaaaaaraaagaaagaaaaaaaaagctttaaaatatttttagaatttttatcaaaatgattcttataaacttaacactcagtttgctttacctaccttaaacatttggttggcaacaaatataaattcctaccactcagagaaaatgaattaagcacttacattgcaaaaaaaaaaaaaagtaatttaaaacgagaatatcagtcagtaaataagattacagagctaaatatcaaatgaatgactcatatggaaagactttcttcaatttttattcctaggtatgtggctcacaggcacttttccct

SEQ ID NO: 9055 - DNA, 601 bp, Human
agaaaatatatctttaaaagctttaaaggccgggtgcggtggctcacgcctgtaatcccagcactttgagaggccgaggtgggtggaccacgaggtcaggagatcgagaccatcctggctaacatggtgaaaccccgtctctactaaaaatataaaaaattagctgggtgtggtggtgggcacctgtggtcccagctactcgggagtctgaggcaggagaatggcgtaaactcggcttgcaatgagccgagattgcgccactgcactccagcctgggtaacagagcaatactccgtctcgaaaaaaaaaaaaagaaagaaagaaaaaaaaagctttaaaatatttttagaatttttatcaaaatgattcttataaacttaacactcagtttgctttacctaccttaaacatttggttggcaacaaatataaattcctaccactcagagaaaatgaattaagcacttacattgcaaaaaaaaaaaaaagtaatttaaaacgagaatatcagtcagtaaataagattacagagctaaatatcaaatgaatgactcatatggaaagactttcttcaatttttattcctaggtatgtggctcaca

SEQ ID NO: 9056 - DNA, 601 bp, Human
ttcattgcaaactaaaaaccagagaaaatatatctttaaaagctttaaaggccgggtgcggtggctcacgcctgtaatcccagcactttgagaggccgaggtgggtggaccacgaggtcaggagatcgagaccatcctggctaacatggtgaaaccccgtctctactaaaaatataaaaaattagctgggtgtggtggtgggcacctgtggtcccagctactcgggagtctgaggcaggagaatggcgtaaactcggcttgcaatgagccgagattgcgccactgcactccagcctgggtracagagcaatactccgtctcgaaaaaaaaaaaaagaaagaaagaaaaaaaaagctttaaaatatttttagaatttttatcaaaatgattcttataaacttaacactcagtttgctttacctaccttaaacatttggttggcaacaaatataaattcctaccactcagagaaaatgaattaagcacttacattgcaaaaaaaaaaaaaagtaatttaaaacgagaatatcagtcagtaaataagattacagagctaaatatcaaatgaatgactcatatggaaagactttcttcaattttt

SEQ ID NO: 9057 - DNA, 601 bp, Human
atcaaaaagaatgtctttctttaataggagtacattacttaagtttgaaaaatgagattggccgggcgcggtggctcacgcctgtaatcccagcactttgggaggccgaggcggggggatcaccaagtcaggagatcaagaccatcctggccaacaaggtgaaactccatctccaataaaaaaaaatacaaaacattagccaggcatggtggtgggcgcctgtagtcccagctactcgggaggctgaggcaagagaatggcctgaacccgggaagcggagcttgtggtgagccgagatcaygccactgcactccagcctgggcgacagagcgagactccatctcaaaaaaaaaaaaagaaaagaaaaatgagattatatgatccctactaactctaaatttcagtgatcctgtgtgtgtgttttaattatttcatcagctcagaatgtcagggtcttctctctttgtatattttcagtataggtattcaactaaaagtagagaagataattcttattttttataattatcactatgaacatgatatcaaatggtgatcctttctctcccgattttaggtaaaatacaattattcagagaag

SEQ ID NO: 9058 - DNA, 601 bp, Human
aattcacagctaacccaatcccgcaagcaattaaaattatgtgcatcaattctctatgggttcaagttgagtttctgtcacttgcaaccaaaagctttctaatatattgtaaatcaaaaagaatgtctttctttaataggagtacattacttaagtttgaaaaatgagattggccgggcgcggtggctcacgcctgtaatcccagcactttgggaggccgaggcggggggatcaccaagtcaggagatcaagaccatcctggccaacaaggtgaaactccatctccaataaaaaaaaatayaaaacattagccaggcatggtggtgggcgcctgtagtcccagctactcgggaggctgaggcaagagaatggcctgaacccgggaagcggagcttgtggtgagccgagatcacgccactgcactccagcctgggcgacagagcgagactccatctcaaaaaaaaaaaaagaaaagaaaaatgagattatatgatccctactaactctaaatttcagtgatcctgtgtgtgtgttttaattatttcatcagctcagaatgtcagggtcttctctctttgtatattttcagtataggtattca

SEQ ID NO: 9059 - DNA, 601 bp, Human
acattatttgattagctaaattcacagctaacccaatcccgcaagcaattaaaattatgtgcatcaattctctatgggttcaagttgagtttctgtcacttgcaaccaaaagctttctaatatattgtaaatcaaaaagaatgtctttctttaataggagtacattacttaagtttgaaaaatgagattggccgggcgcggtggctcacgcctgtaatcccagcactttgggaggccgaggcggggggatcaccaagtcaggagatcaagaccatcctggccaacaaggtgaaactccatytccaataaaaaaaaatacaaaacattagccaggcatggtggtgggcgcctgtagtcccagctactcgggaggctgaggcaagagaatggcctgaacccgggaagcggagcttgtggtgagccgagatcacgccactgcactccagcctgggcgacagagcgagactccatctcaaaaaaaaaaaaagaaaagaaaaatgagattatatgatccctactaactctaaatttcagtgatcctgtgtgtgtgttttaattatttcatcagctcagaatgtcagggtcttctctctttgtatat

SEQ ID NO: 9060 - DNA, 601 bp, Human
cttatatggaaatctgctaaaattagggaaaacacaaaataactcacataaaaaattatgttggctacttttcctgctcttggatccttattttatacagtttcagttacgttgtttgcataatttgacctggatccactactcaaatttggaaaaatacttaaaagaatgaaactattcaatctgagaaactgatactcggctctcctggtgagaaaaaagaactcttacagctgaaagagatttttaagctcacttatgaatctctccgccttgagtcttcaccctctttcacctcccrtcttaaagtttgaggttcattaacttgagccagtcacaaagttagctaatagcaaagctggaaacaaaatctgggggtctgggctcccattccagttccctttccagtaccttacacaatcccacaaaaacttctgttcgaaccattaataaaattcatctaaaaaatgaaaatgacatttaaagtctatgaaatcactatgctgtcagaacttaattcccatctaccaggataaggaaatgcctatcaaagtttgtgattacatttaaggcactgatgatgctcaaggtaaaatggtaa

SEQ ID NO: 9061 - DNA, 601 bp, Human
ttcatattaagattaggtgataaacatttaactgaaaaaaataaatgcaagaatataatttgtttttttcagtactacttagagactttttttttgtcaaaaataagttatagatttggggactattttttcccaaaatataaaagttaaaactgtttgacaacaaatgtaaaaaaaatacaataattacctatgatgaacaccatagcaatacttcataattctaaactggagcacagttttaatatctgataaaacaacgctttaacactctgctataggtaatttatggattaaattggctgttttagttcttatccatgggtacttacttgggtaaatcctaaaagtagggtgataccaatccttggacctcaaaaatgtccatatagcaagtccattgagcagtaacttttgggggagatttgcagggtgtatttttgtgtttataagtcagctactaaaatgccatcctcttttctcttttcaatgcctttttcattagtcatgtgaattaatcactaataccagcattgcaaagagtatactaaattttctgactggaaagtatgattgataacttatatggaaatctgctaaa

SEQ ID NO: 9062 - DNA, 601 bp, Human
gactaatatctacacttacatataacaaaattttctgaatttcatattaagattaggtgataaacatttaactgaaaaaaataaatgcaagaatataatttgtttttttcagtactacttagagactttttttttgtcaaaaataagttatagatttggggactattttttcccaaaatataaaagttaaaactgtttgacaacaaatgtaaaaaaaatacaataattacctatgatgaacaccatagcaatacttcataattctaaactggagcacagttttaatatctgataaaacaaygctttaacactctgctataggtaatttatggattaaattggctgttttagttcttatccatgggtacttacttgggtaaatcctaaaagtagggtgataccaatccttggacctcaaaaatgtccatatagcaagtccattgagcagtaacttttgggggagatttgcagggtgtatttttgtgtttataagtcagctactaaaatgccatcctcttttctcttttcaatgcctttttcattagtcatgtgaattaatcactaataccagcattgcaaagagtatactaaattttctgac

SEQ ID NO: 9063 - DNA, 601 bp, Human
cttctctacagaggtatttcatattaaaataaaagagagagggctgttttcatgtattttttcaaattacaatttaaaaaatggactcctcagactaatatctacacttacatataacaaaattttctgaatttcatattaagattaggtgataaacatttaactgaaaaaaataaatgcaagaatataatttgtttttttcagtactacttagagactttttttttgtcaaaaataagttatagatttggggactattttttcccaaaatataaaagttaaaactgtttgacaacaaatktaaaaaaaatacaataattacctatgatgaacaccatagcaatacttcataattctaaactggagcacagttttaatatctgataaaacaacgctttaacactctgctataggtaatttatggattaaattggctgttttagttcttatccatgggtacttacttgggtaaatcctaaaagtagggtgataccaatccttggacctcaaaaatgtccatatagcaagtccattgagcagtaacttttgggggagatttgcagggtgtatttttgtgtttataagtcagctactaaaatgc

SEQ ID NO: 9064 - DNA, 601 bp, Human
cctcacgagttaaaagtataactaggtgaaacctactcgtagagcaactagtttaatacgttttgcactctggcctaaaataatgtatcaaaggataaaaatcctttgaaaatatactgtactagggtatttgtgttctaatgctaaaaagataattataatggcctagtaccgaaattttcaaccactctattttaaaatgtcatttgagatttcccaatttttatactctgaaattatatatggaaactaaactcacttgggcagtctttaggcacatcattaagtaatgtgcttccayagaaagaggccgtagaagaaaatgttaacctcttcctgagttagaaacctcatgacattaaatctatgagcctttgctttgcttgcattaatattgacactgactttcagtatagcacagtgattaagggccctagatgagacagacttaggctttaaccccagaatcacctctttctaagaatatgaccttaggtacattatttactctctttgtaaaatggagatcatgataaaagtaaaggaaatgatgctggagtcagatacacagtgtttcattcatgatagttattgtttttaa

SEQ ID NO: 9065 - DNA, 601 bp, Human
taacagcaccgcacctgtcaagaggatgatgttattgtgtgagtagagcacccagcaaaactaatgagcatgtgcactaccctggttccagcagctgctgcaggaaaaggcgaaagttgacagacattttgtgtctttagtaatacaaagggatgaacaaattcattcgtgaatgataaaaaaaaaaaggaattctggaggttaggaagcttagaaggtgaatggttatcaacttttacaatagttttaacaaagagtttattttatcaaaattacacacggcaaaaatacaatgctattycattttacacatactatgtgctcatattttgtaactaaatgaaaagtgtggcactcttaaaatgatggactcaattaagttaatgattaaattaaatagtgccaagttagtattgtaatacatttttatggatatttaaatagatttgtattgcatattgggtacacttcatctcatagtctctaaaaagtttataaattgattaataatattcattgaaaaaaatgaaatgtaactgtatggcatataatctgggaagaatcaaaaccttcccccctttccaatttatcgcttccactc

SEQ ID NO: 9066 - DNA, 601 bp, Human
gtttaacacattttgatttcatgaagctaacagcaccgcacctgtcaagaggatgatgttattgtgtgagtagagcacccagcaaaactaatgagcatgtgcactaccctggttccagcagctgctgcaggaaaaggcgaaagttgacagacattttgtgtctttagtaatacaaagggatgaacaaattcattcgtgaatgataaaaaaaaaaaggaattctggaggttaggaagcttagaaggtgaatggttatcaacttttacaatagttttaacaaagagtttattttatcaaaatkacacacggcaaaaatacaatgctatttcattttacacatactatgtgctcatattttgtaactaaatgaaaagtgtggcactcttaaaatgatggactcaattaagttaatgattaaattaaatagtgccaagttagtattgtaatacatttttatggatatttaaatagatttgtattgcatattgggtacacttcatctcatagtctctaaaaagtttataaattgattaataatattcattgaaaaaaatgaaatgtaactgtatggcatataatctgggaagaatcaaaaccttcc

SEQ ID NO: 9067 - DNA, 601 bp, Human
acggagcaagcaaagaaccccaaaattcatattaattagatggtaggacataaaaccaaatggaagttgcctaaaaccttttgagctcttgtcataaatgtgactcaaatcttactctcgaaactctttacacaatgaatcaaatcagaagtttattatccagatattctactttacagaagactcttgcagctcaaactgcttataaaataatgatttaatataaaaatcagtgtcattaagcataatgtttaacacattttgatttcatgaagctaacagcaccgcacctgtcaagagtatgatgttattgtgtgagtagagcacccagcaaaactaatgagcatgtgcactaccctggttccagcagctgctgcaggaaaaggcgaaagttgacagacattttgtgtctttagtaatacaaagggatgaacaaattcattcgtgaatgataaaaaaaaaaaggaattctggaggttaggaagcttagaaggtgaatggttatcaacttttacaatagttttaacaaagagtttattttatcaaaattacacacggcaaaaatacaatgctatttcattttacacatactatgtgctca

SEQ ID NO: 9068 - DNA, 601 bp, Human
ggagcaatggctgttatttcctcaaaaaggtcagccaagagaatcagaaaaaggatgagagtaaaaaggttgtttttggtgatacaagcccacaggttgaggggccctaactgggttgggatataggccagcaacatgcaccatgaacactcaaaagtccttggccaaagcaaatacttcagaatggcattcttgacagactcctactaagttcaaaaaaaaaaaagaaaaaaaaaagagaacagtttaaattacatcatagccatctgagcaaaaacaacaaaacagaaacaaattccaytgaagcatctgtagcttttaccacaagtactaataatctggactctccactttcatgtataagtgtatctttgctaactgccctgcaaacctggaagcaatcagaagaaagcctagctgccctcttgaagtctttcagttaacttttacaaagctattaatgaaagacaacaggccctccacacttcaaagaaagccacagccatggaaaatgcaatgaacattgaagccaataatttatagtcaatgataagagcctgagttttacatcacatccatatcttcctctcttctcaccaaa

SEQ ID NO: 9069 - DNA, 601 bp, Human
ttatgaagtgtaaggtgctgactgtcttcagcagagtataaagtcaggaatattagactaacaatcaggtgataattctagttccagctacaacactacatggatctgatgctaaaacaattacaacttctctggagttcattttcactggagtttgagatcttcagtggtaaaaatgggctgctgtattaacaggctattaagactccccaccacagtttgcagtatgaataggacaagaagtggtccttgggtctgtcaacttaacttctttttgcccttcaacttcctcatttttaartaggggaaaagtcttctggctccttcactcactgcacagggttgatgtgtgagtcaaattagaaaatgcacatggaagcatttcaagatctcttcaacatatctaagaatttgctatctcttacacccttagtactcattccaatgaagacaaagggctgggttaaggagcaatggctgttatttcctcaaaaaggtcagccaagagaatcagaaaaaggatgagagtaaaaaggttgtttttggtgatacaagcccacaggttgaggggccctaactgggttgggatataggccagcaa

SEQ ID NO: 9070 - DNA, 601 bp, Human
ggtggcaacaccaggaatcaaatccaggtttcctattccaggtactataccctattaagaatataaaagttcccagagcatcagtgcttgccatgaagaaggcactccgtaacatctagctgaatctagaagtaaaaatcaaattcaagcagagaaggcatagagaaagatgacttacgacacatgttcaaatgaaatcctttacctccaggtcataaaaggaccacacactgttttcttaaggtaaaaacactatttctaaggactcagggaacaaagattcttaaggatagtgtccataaaaaaaaaatctaactaaattccaacatatctatgtttctctgaaaacaggtcacattttataagtctaaagcaatgtactgaaaagaagtataataaatgtgttcgagaaaaagtcatccccagagttgctagatttagcaaataaaaaagacaacctgctaaaaatgagtttcagataaataatgaataagttttcagtataagtagtatctgaaattcaagatgaactggctgtcctgtatttgatctggccactccagtcattctacatagcttttcctaactgaaattgttggcg

SEQ ID NO: 9071 - DNA, 601 bp, Human
aattatcatgatctttcctttcaaacttaaaagtttatattgtgttcagaagttatatacatattggatgtttctggcatatgaagttaggtaaatgtacacaaataagtaacggaaaagatgattgtgaacatgtccaatataaaagtagaaagcaacggatggaaatccagaaacctcagtagtagttctgactgggtaatcacttcgatggtctaggataggacctctattttcctttccctttattaattctagggggttttgaaaaatattcacattagtgctactgaaaaaaaamccataattttatttaaacctggtgaggcaggcattaatggtcctactttctaaaatatgaagctaattaaatgtctgaaccacacccattctactatttggtggcaacaccaggaatcaaatccaggtttcctattccaggtactataccctattaagaatataaaagttcccagagcatcagtgcttgccatgaagaaggcactccgtaacatctagctgaatctagaagtaaaaatcaaattcaagcagagaaggcatagagaaagatgacttacgacacatgttcaaatgaaatcct

SEQ ID NO: 9072 - DNA, 601 bp, Human
atgactgaaagcttcctgaggcctccccagaagctgggcagatgccaacaccatgcttcctgtaaagcctgcagaaccataagccaattaaacctcttttctttataaattacccagccttgggtatttctttaaatcaatggaagaacaacctattagagggcccttataaggggcctatgggagcttgttaactccttttgcccttctgtgaggacacataaaagttgacatctatgaggaagaagcctccaccagaatctgctggtgccttgatcttggacttcccagcatctgaaaytgtgagcaacaaatttgtgtttataaattatccagtctaagctatttgttatagcagccagcatggactaagacaatatagattttctagacatagactaaagtgatgttggagaatccttctactattacacaaagccactgacaattaagagttatgcccaattaaagaccagttaacaattgaagaaacaatcaataaggataatgacatagcagatactcacaaagagaatattagtcaaataattatattctgaattaagaaagccccttgggcaaagctgatgaagccttcaaa

SEQ ID NO: 9073 - DNA, 601 bp, Human
actccactgatttttaaaaaatacttcagtctgtatgcaaatacaaatcacctgcaaattgaaattaaaattcttatataagacatatgctatggtctaaaatgtatgtccctacaaaattcttctcttgaaccctaaccccgaaggtgatagtattaggaggtggggcctttgggagggttctgccctcataaataggattagtgcctgatgtagtttggatgtcccctcaaaatctcatgttgaaatgtaatccccagtgttgaaggtggggcttagtgagaggtaattggattatggsggcagatccctcatgaatggcttcacaccatccccttcatgatgagtgagttcatggccttgtttaaaagttgtttgtttaaaagtacatggtacctcccaccatcccgtccttgttctcattcttgctcctgctcttgctataactttctcaccatatgatatgcaggtttccacttcactttccatatgactgaaagcttcctgaggcctccccagaagctgggcagatgccaacaccatgcttcctgtaaagcctgcagaaccataagccaattaaacctcttttctttataaatta

SEQ ID NO: 9074 - DNA, 601 bp, Human
acataggaaaagcagatgtagcatattcagtcagtcaatcaacaatccgtattaaccaccagtggtagggaaagagagttctcatgactacattattgattatctgagtccctgtaattacatacttgcagaggaaaacatgttatcataacatcaaaatcactgatgaaccaaccacaaataaaattaaatcatttctcacacatctttccctttgagcattccttggagttctgcagtgcacaatctatatggccaaatgaagtgggcctttgcccttaagactaatatctatactccrctgatttttaaaaaatacttcagtctgtatgcaaatacaaatcacctgcaaattgaaattaaaattcttatataagacatatgctatggtctaaaatgtatgtccctacaaaattcttctcttgaaccctaaccccgaaggtgatagtattaggaggtggggcctttgggagggttctgccctcataaataggattagtgcctgatgtagtttggatgtcccctcaaaatctcatgttgaaatgtaatccccagtgttgaaggtggggcttagtgagaggtaattggattatgggggcag

SEQ ID NO: 9075 - DNA, 601 bp, Human
agtggtcctgacacatcatgttcttatcctacataatttaaattctcactatctgctatttttcttgtttatcaatctgttgttatatcatctatcccctctgactagatatttcattagtgctacgtgttcactgctgcatctcctgtacttagattaatgcttaccacatacagtagtaggtcctcaaaatatttcttgaagtaaatgaataaataaatgaagcctcctgaagcatcaaaaggtacaacagtcttttgaatatctaaatgctggtgtgtttattacagaaaatcaacattgtgttttagcgattactgttcatcaccccttggatgtgtaagtctcacaactgaccgtgactaatttatgcttgtatacttgcagtgcctggtgcagcatatgtcttaagcagagccagtgcctaaaagttctacattatgtgtttgtgattactctatttgtctcataaatgttgcttacggatattttcttagagacattaactcaatattaaatgacataggaaaagcagatgtagcatattcagtcagtcaatcaacaatccgtattaaccaccagtggtagggaaagagagttc

SEQ ID NO: 9076 - DNA, 601 bp, Human
gccagttttcccacatatggagtaccatcacctccacagttactcaaaccaaacacgtaggaattactctaaatttctgtttccttcaactctcacattcagttgcgcagtcaagttctgtcaacctgacttccaaaatcctatatcccaatctgcttatttctatctccattactaccaccctggtccaaaccccactatctctcagttggattgttgccatagtcccctaattaatctctctgatcctatacttacccccttgcaatcccattctccacacagcagccacagtaaattytcagcaaagtatgtcaacatcttagctaccctacttggcttttcattgaactgagaataaaacctgagctcttgtaatcccctacaaataggttcctctcgcccatgccagcatccttggcgctcctgaagcacaccaagcactaactgccctgtctgggatgctctcccctcattggcacatggctgatccacttccacatcccctgctcaaacaagtcatctctgactgctccacctaaagtggtcctgacacatcatgttcttatcctacataatttaaattctcactatctgctat

SEQ ID NO: 9077 - DNA, 601 bp, Human
tatatttaaaaattgctgaaagagattttaagggttctcaccacaaaaaacgataagtatgaggcaatgcatatgtaaactaccttgacttagccattccacaatgtatacatacatcaaagcatcatgctgtacaccttaaatacataaaattcttgtcaattaaaaaataaatttaaaaatatccaatgagtaatttaaaggaaaacaacatcactggccttatgaattgactgactttctaataaagaggtattacaaatttgaagaagcacaaaagcaatgtggtaggtaagtgtaytgtacaaatcacaagcatatacctacacagatttttaaaaacatataattgtcctaatgtttcatagatgcatgctgtgacttaggacaaaatttccggtgaagacaacatacattaattaaaataattcagtatctgaaaaccttagaagtgaaggtgacacactctgggatttgcttatgtagcccccagaattgcactaatagtgccaaagacactgatgctaaaaatgcatgtgaagctgccaacagtgcataggaagctttcaaataaaactgtttggaaaagataagacaggaa

SEQ ID NO: 9078 - DNA, 601 bp, Human
agttataaaagtctccaaaaagtttaggagaaataagttcaagagatccattgtaaatatggtgactatagttaataataatgtattgtatatttaaaaattgctgaaagagattttaagggttctcaccacaaaaaacgataagtatgaggcaatgcatatgtaaactaccttgacttagccattccacaatgtatacatacatcaaagcatcatgctgtacaccttaaatacataaaattcttgtcaattaaaaaataaatttaaaaatatccaatgagtaatttaaaggaaaacaacmtcactggccttatgaattgactgactttctaataaagaggtattacaaatttgaagaagcacaaaagcaatgtggtaggtaagtgtactgtacaaatcacaagcatatacctacacagatttttaaaaacatataattgtcctaatgtttcatagatgcatgctgtgacttaggacaaaatttccggtgaagacaacatacattaattaaaataattcagtatctgaaaaccttagaagtgaaggtgacacactctgggatttgcttatgtagcccccagaattgcactaatagtgccaa

SEQ ID NO: 9079 - DNA, 601 bp, Human
aattagctgggcatgatagcatgtgcctatgatcctaactactggggagactgaggcaggagggttgcttgagcccaggagttcgaggctgtagtgaggtatgatgacaccactgcaccactgcacttcagcctgggtgacaaagtgagactctctcaaaaaaaaaagacaattttattttggaaaacaatagaggacaattgctttaatgaacatcttaataaaggctgacttctatatacataactttatatatctgattgcagcataccaagcataaagtctgcttctctcaaaattrgcttatattaaaaagtaaaagacactaaatttgccaatagttttaggaaaatataaatatgcacattaatttgatgtttaaaacacataacttgttctgaagttaaatatttgaaaactaaaacaaatatttgtctaaatttggcttgctactatgcctattttagatagttatatctatattgcaaaagtagataagtttagaaggattaatgaaagaaacaaataatttaatcttgtatagaaaaatcagacttctgtaaatattatcccaataatgtttgtttaataatggtaaaaa

SEQ ID NO: 9080 - DNA, 601 bp, Human
tctaggaaaaattaaaaaattagctgggcatgatagcatgtgcctatgatcctaactactggggagactgaggcaggagggttgcttgagcccaggagttcgaggctgtagtgaggtatgatgacaccactgcaccactgcacttcagcctgggtgacaaagtgagactctctcaaaaaaaaaagacaattttattttggaaaacaatagaggacaattgctttaatgaacatcttaataaaggctgacttctatatacataactttatatatctgattgcagcataccaagcataaagtmtgcttctctcaaaattagcttatattaaaaagtaaaagacactaaatttgccaatagttttaggaaaatataaatatgcacattaatttgatgtttaaaacacataacttgttctgaagttaaatatttgaaaactaaaacaaatatttgtctaaatttggcttgctactatgcctattttagatagttatatctatattgcaaaagtagataagtttagaaggattaatgaaagaaacaaataatttaatcttgtatagaaaaatcagacttctgtaaatattatcccaataatgtttg

SEQ ID NO: 9081 - DNA, 601 bp, Human
cctaaacatcttctcatggtaaactgatgagataataatttgatatgttatagaaaataaaaacaagatggtttacttaagacatatgattttggccaggcacagtggttcacacctgtaattccaccaccttgggaggctgaggtgggaggactgcatgaggccaggagttggagaccaacctgggaaacctagtgagaccctgtctctaggaaaaattaaaaaattagctgggcatgatagcatgtgcctatgatcctaactactggggagactgaggcaggagggttgcttgagcccmggagttcgaggctgtagtgaggtatgatgacaccactgcaccactgcacttcagcctgggtgacaaagtgagactctctcaaaaaaaaaagacaattttattttggaaaacaatagaggacaattgctttaatgaacatcttaataaaggctgacttctatatacataactttatatatctgattgcagcataccaagcataaagtctgcttctctcaaaattagcttatattaaaaagtaaaagacactaaatttgccaatagttttaggaaaatataaatatgcacattaatttgatg

SEQ ID NO: 9082 - DNA, 601 bp, Human; identical to SEQ ID NO: 1437

SEQ ID NO: 9083 - DNA, 601 bp, Human
ttatggatggtgcttagtaatgaattatccattagccaactgacttccactgctaatatcaatataaattagatcacaatgtaaattagatcacagatcaacccccacaagttctaatgaaattcttgggacatgaaataactcctgcaaggctactataaatacagatcaagggtaccaaatgtgaagtagcaacatgacaaatccacaggctaagaggcatcaccctgggagcagtgcaaatcaaggacactagctgttttaaacaatagtacaagaattaaatcattatcaaatgcamaacagaaaatacattgtcaaaactttgaagatggtaggcagattaaataaaacacatataagtgaagaattctcagggctggagacacttaggaccatgaagacaaataaagactttctcaacaaagctagagaatatttatgatcctactgtactcttgggaccatagtgccattgaaaagtggatacccagctgtcacttaagacaggaaggggattctgcaaacttggcagcaatccttcagctgtgtccttaatacccctcttggaatctgctacagtgtgaagttattacagagc

SEQ ID NO: 9084 - DNA, 601 bp, Human
catacatacatacatacatacatacatggtgtggcacattgaaggtagttgcatgatggtgggctgatgcatgagaccgtgtgtgactgaacatcaatgtacaggtagcatttaccaactaatcttttcattggtatttatgggtctacatgagaatcactggtctgagtagtggatcctgtcttgtattttgaatatacgaatatgttttcttatcagtaataaaactatagaatttttcaaatttatatcagtttatatcattttctgttacaaagttttaaaagtgaactaaatatargtcatttgttataattaactttatgagactttaaaaaaaattctcagcatcaatctgagtattattctgtttcacagacacctctcttggtttcccacagtgacattacatcctttaaagtggtctacgatcaaataagcttaagaaatactgccatacagtgtcatttttacagatgcatgtttaaagagctaggactcagaaaacattagaatatattttcatatcctgactactttcaaaaaacatagtattttaattattcaaattatggatggtgcttagtaatgaattatccat

SEQ ID NO: 9085 - DNA, 601 bp, Human
taatagcttcttagtataagtgttaatatcttattaataaatgtgttaatatcttcttgttattcataaatgccgtgccaagccggctgcagtggcatgcacctgtggtcccacctactcaggaccatagccacttctcgtgcagttgaagtgagtggatcagctaatccaggactccaacctgagcaacacagtgagactctggcttaaaataaatacatacatacatacatacatacatacatacatggtgtggcacattgaaggtagttgcatgatggtgggctgatgcatgagaccrtgtgtgactgaacatcaatgtacaggtagcatttaccaactaatcttttcattggtatttatgggtctacatgagaatcactggtctgagtagtggatcctgtcttgtattttgaatatacgaatatgttttcttatcagtaataaaactatagaatttttcaaatttatatcagtttatatcattttctgttacaaagttttaaaagtgaactaaatataggtcatttgttataattaactttatgagactttaaaaaaaattctcagcatcaatctgagtattattctgtttcacaga

SEQ ID NO: 9086 - DNA, 601 bp, Human
ttgctaggggttttctttttcttctaaaattcatctggaaataatcatctgaaattcagttgaaacaattcgtatttctttagaaaaatatattgataaatagttgaaatagaaagtaagaaactgcatggtgaaagaaggtgaaaatttgtttctctggagaaataaaaatgaaagggaaagatgaagtggggaaggaaggaataatagctacatggtcaaggccacataagtggcaatttgacccttccctaagaccctctaagttttctctctagaaatcatggttcacatggagtgwctgtcctggagtagaaacaggacatgagtctgagttttgcactctaattgacttgggagaaggagagatgttttgacaatgtaaatccttaagacatatgaatcatgggaaggtttaagacttcctcaggacatggaatggggttcagggcaatcctgtgtagttattggatgttatctggttttcctataaaaggaaaataccaagcacatttatatagtagttctgattatatatcttactattaatagcttcttagtataagtgttaatatcttattaataaatgtgttaatatctt

SEQ ID NO: 9087 - DNA, 601 bp, Human
gcaagagaatattcttattagaaaatatacactgaactatttagtaaaaacatatctttagcttattaaatctttcagaaataataagcatatattccttatatgcattatagagtgaaaaagaggaaacgataaagcaaatggggcaaaaaaataactggagaatctgggtaaagggtgtatggcagtttcttatactggtcttgcaacttttctgtgagtttaaaattatatcaaaataaaaataacagaaaattttaaaaaggaaacaacacagatgacttgacaaattataaggctkgttttcttccacagagtggaatttttaagacaatgcctgaaacattgaacaagcatagacacagcagttcccaaactgtgttcccaggggcacagttacacttctattaggagatttgtctaaattacaacaattgctaggggttttctttttcttctaaaattcatctggaaataatcatctgaaattcagttgaaacaattcgtatttctttagaaaaatatattgataaatagttgaaatagaaagtaagaaactgcatggtgaaagaaggtgaaaatttgtttctctggagaaata

SEQ ID NO: 9088 - DNA, 601 bp, Human
ggcaggcttgtgggattgagcccttaacatgtagggtcagtgctaactccatgaggttaagaatcagaactgaattgggttgaactgggttgcagtgtcaaagaactggaaaattaaatagtcgttgcttagttaaggtgtcagcattaacatatatggtattccagctaaaagggcctagcttgaatctatttgtgaaggacattctacaaaataacaggcctgtaccctttaacaatgtctaaatttaaaaagataaagaaatgctgagaaactgtttcagatggaggggagactaaasagacattacaactatgtgcaatatgggatcctgaatactatcttggattgggggaaaataactctaaagcttattaataggatgggacaactgatgaaattttgactatggactgttaatagtcttgtatcagattagataatagtattctatcaatataaaatttcctgattttgataattttattatggctgggcaagagaatattcttattagaaaatatacactgaactatttagtaaaaacatatctttagcttattaaatctttcagaaataataagcatatattccttatatg

SEQ ID NO: 9089 - DNA, 601 bp, Human
catgaatgaaggagaaggcaaaactctctcttacattagaatttcagctaataaatataagaggtatgatggagttagaaaatcagtggatgctaaagctggtcaataggttgttgatgaacacagtatttacacagtctcaaagtatctgcccatatgatacttattaattacaatgggaaaaactattggagaaacctggtagatatcactttaaaaaagttatcaaatttaacatcatcaatacttacatcacataaatatgcctccttataagatacactacgaaggtgtgtggtayaattaaacatgtttctgatctttgttcccagttcctgacacagacctcctaaaggccatgggatttcttgagtgatactagtgtatttccatatttgcaacaagcccttttcaaccatacccgaattcacactaatgaggtgagccctagaaggcttcaggattaggggtgggaaccagaaaacccaaccttgtgattagaggtttagaacttccagtcccacccccaacctctggagaggggagactggctggagattgaatccactcaccaatggccaataatgtaatcaatcatacc

SEQ ID NO: 9090 - DNA, 601 bp, Human
atgccccaaaattaataaggacataacaaaaaggactcagcaaatttgttataatttgaacatcagcataaagataataagagaacataattgactaaataaaatattacacgagtccataattgatgtgaatgcatgaatgaaggagaaggcaaaactctctcttacattagaatttcagctaataaatataagaggtatgatggagttagaaaatcagtggatgctaaagctggtcaataggttgttgatgaacacagtatttacacagtctcaaagtatctgcccatatgatacttaytaattacaatgggaaaaactattggagaaacctggtagatatcactttaaaaaagttatcaaatttaacatcatcaatacttacatcacataaatatgcctccttataagatacactacgaaggtgtgtggtacaattaaacatgtttctgatctttgttcccagttcctgacacagacctcctaaaggccatgggatttcttgagtgatactagtgtatttccatatttgcaacaagcccttttcaaccatacccgaattcacactaatgaggtgagccctagaaggcttcaggattag

SEQ ID NO: 9091 - DNA, 601 bp, Human
tgtagtgaaacagactatgaccagcagacaatacaaaatcaccacatatgtaaagaaacaggaaaatgaaacccatagtaaagagaaaaagtagtcaataaaaaatgaccccaagatgattcacatgttggacttcacagataaggactttaaagcagctattaaaaattaatgtagggatttaaagaaaaatatagtaataacttctttgcagagataggaatctctgcaaggaaagaaaaaactattaaaatagtcaaatgaaaattctagaactgaaaagtatagtgtgtaaaacacsaagttcattaatacatttaacagcccaccgaaaacagctgaagagtcagtgactctgaagataaatcaacagaaagtatccattcagaaggattgaaagagaaaacaaaccataaaacattaacaaagtttcagtgtcttttaggatactatcaagtgtgtatacacacacacacacacacacacacacacacacacacacacatacatatatttggagtcccaaagataatgaagctgaaaaatatttaaagacttataaagaaaaatttcccaaattgatgaaaaccttaagcttaca

SEQ ID NO: 9092 - DNA, 601 bp, Human
ggaacactacaatcattgtgattattcctttcactgtttgtttacaagaacatgacagtatgaaagaacacaagccttggatgtccacttgccataacaaagtatcaggtaccagaattccttcctgctgaagacatctataagactagacaaaatacaagacaacaaagccatgggcagagcaaagaaaaagacaacataagtaattgccattcaacattctggctttctgcctgagggcgttttcctgctttagagaaggcaggtgctacccaatgagagcaacgctttgaaacagaaytgaatggagctccaaacttctgaagtggttggaaagtataaagcacaggggctgtgctggggggttggaaggaagatggttaggaagcagtgaccaaaagatactgagtttctagtcactttgggcatgtatagggcaaaaaacctaaaggactagcaaaaattacctgctgaaggctaaaaactgaatgtgacaccaattagtgaagtgtttggagacaatggagttccagcccagccagagtagagaattcattcagcagcgcaggcattgaggcaggaaaagaccactccttaggag

SEQ ID NO: 9093 - DNA, 601 bp, Human
gaattcccttcagagaatatggaatatccacactggaaaagctcatcttttgatgagctttgaaggtcatttctttttaaaaaaataaaaaataaattagtcacagtaaagctgtgaatgaagtgattacactagattccatcaattggggtcagaaatgaggccaattttcaactgagagggcccaacttagcttaaagataatttcaaaagaaaaggtataaaatggtgaaaaatcaatataaatattttatattataaacactactacatttttgctttttctgcaaacatgctcaawgttatatgaattgagatgcagagaaaaactttagctgaatcttcctaataaaattcttattttatctttagatattgtctaaagaaagcagacaagataatgttgatgaattaaagaagtgaaaaattattgatatatagtgaattattttacaaaccaataagtaaaacatgaataaaaatacatcctcagtgttactttgttaataaacatttgaattatgagacaatttataaagaagacttaacccaactacctaatcaaagcagtagagtttgacagattaaatttagtaggact

SEQ ID NO: 9094 - DNA, 601 bp, Human
ctgttcccttcaaagcgatagccttggggagttacatgcttaatctaataatagcatcactgctccaaaaactacgcagttggaattcccttcagagaatatggaatatccacactggaaaagctcatcttttgatgagctttgaaggtcatttctttttaaaaaaataaaaaataaattagtcacagtaaagctgtgaatgaagtgattacactagattccatcaattggggtcagaaatgaggccaattttcaactgagagggcccaacttagcttaaagataatttcaaaagaaaagstataaaatggtgaaaaatcaatataaatattttatattataaacactactacatttttgctttttctgcaaacatgctcaaagttatatgaattgagatgcagagaaaaactttagctgaatcttcctaataaaattcttattttatctttagatattgtctaaagaaagcagacaagataatgttgatgaattaaagaagtgaaaaattattgatatatagtgaattattttacaaaccaataagtaaaacatgaataaaaatacatcctcagtgttactttgttaataaacatttgaa

SEQ ID NO: 9095 - DNA, 601 bp, Human
gagtgctgttcccttcaaagcgatagccttggggagttacatgcttaatctaataatagcatcactgctccaaaaactacgcagttggaattcccttcagagaatatggaatatccacactggaaaagctcatcttttgatgagctttgaaggtcatttctttttaaaaaaataaaaaataaattagtcacagtaaagctgtgaatgaagtgattacactagattccatcaattggggtcagaaatgaggccaattttcaactgagagggcccaacttagcttaaagataatttcaaaagmaaaggtataaaatggtgaaaaatcaatataaatattttatattataaacactactacatttttgctttttctgcaaacatgctcaaagttatatgaattgagatgcagagaaaaactttagctgaatcttcctaataaaattcttattttatctttagatattgtctaaagaaagcagacaagataatgttgatgaattaaagaagtgaaaaattattgatatatagtgaattattttacaaaccaataagtaaaacatgaataaaaatacatcctcagtgttactttgttaataaacat

SEQ ID NO: 9096 - DNA, 601 bp, Human
ttttttttctttttttgttcattactgtattcctagcacaggaactcaatcaaaagcatgcgttaaatcaatgaaggaattcattaacaaataataccacggttatcaaatgttatcatttttaccttaccatatagtttaaagcaaatcttgtcagtaaagggaaaaccaaagtagaggaaatcaatagctacaacaacatgaggttagagtggaatggaatcaagcattccaggacataaacatctgaatgagtgctgttcccttcaaagcgatagccttggggagttacatgcttaayctaataatagcatcactgctccaaaaactacgcagttggaattcccttcagagaatatggaatatccacactggaaaagctcatcttttgatgagctttgaaggtcatttctttttaaaaaaataaaaaataaattagtcacagtaaagctgtgaatgaagtgattacactagattccatcaattggggtcagaaatgaggccaattttcaactgagagggcccaacttagcttaaagataatttcaaaagaaaaggtataaaatggtgaaaaatcaatataaatattttatattataaa

SEQ ID NO: 9097 - DNA, 601 bp, Human
gatcctagtatggaaaaagaaattcaatttaatgactgacctgttcaaagattgatttgatttttctgatttattagattagagaaatctaaccttggacttaccttgttactctgagtaacaattttattgttgtgaaaggcatcatcatgtaagtacatattatatttgacaaagataaattgaagttgctgagcttttttataagcagctagtgtttaagagaaaaaaatacagactcgaacaaatgttcagaaataaagaaaattcaaaatattaaccactttagatagctgtactwaaattcaggaaaaagtggcatctctccacctctgtaatatcatctcacaacctgattctattgtgcctccagaacaaccttttcaataaatgactttacttcccttgtaagggctcttttacagttcttcagtattctgtacttctatctcaagtattcctaagagtttaaattatacacatatatacacaatctcattgagtcagattgtaaacaatcctttaatcttttgaatttccccttttacaaggcacattatacacacccaataatcataaaggacttctgaggtgttaaatt

SEQ ID NO: 9098 - DNA, 601 bp, Human
atataaactaacatattttcatttgcctgttaaaatttcaaattgaaatttacataattagaattagctatgatttccatttttttcaaaacctcaatttgaatgaaatccgttaatgaccactgtagttggatgagcatttatgaatactactcatactcctaaaacataatatgcaatgaattgatcctaatcacaaccataattacatatcttaagatagaataacgccttcaggaagaggggaggtagaatatgacatgcataaaatttatttctaagtaaatgggcatagtaaagyaattatcagaattaggccctgtaactaaaaatctaaatagaaaaaaaatcaagcagaacatttaagaactttatagctaatttgtcactaaagcattatttcatatatatgcaaagtaaatacaaaatatttttcaaaaagaaaaatatttccaatgaccttttataaaatggaaaattggcttacctcttccctatgattcttaattggcatacaaagaatgctttgtgtcttgtagcctgtaatttggtcaacttctgcattgaaccgaggatcctagtatggaaaaagaaattcaat

SEQ ID NO: 9099 - DNA, 601 bp, Human
tagaagcatcaagtacttctaatatgattggcagtggttctcaaccttggccacacactgcagtcatttgggagctttaacaaatactaatacctgggtcccaatccctgagattctgatttaaggtgaaacctcggcattagaatttttaaatgctatacccagataactggtaaaacatttccgcgtgtgtctgtgagggtgttcccagaagaaattagcatttgaatcagtagactgagtgaaaaagattctccctcaccaatgtaggtgggcatcatccaatccactaagggcccaracagaacaaaaaggcagaggaagagcatatattgctctctcttcggaagctgggacatccatcttctccctcctctgagacaacagaacttcaaatactcagatccttggattctaggactcacaccagcaaatctcccatttctcaggccttcagcctcagactgaattacaccacaggttttcctgttctccagcttgaagatggcagactgtgggacctcttggtctccataattgcatgagctaatttccataaataaatcccctcatatatcctcatatatcctattgattctgt

SEQ ID NO: 9100 - DNA, 601 bp, Human
aaaaatcaatggggtttggtaacacactagatggaggaaggagaataaatgtcagaatttgaatataaatcaagtagaagcatcaagtacttctaatatgattggcagtggttctcaaccttggccacacactgcagtcatttgggagctttaacaaatactaatacctgggtcccaatccctgagattctgatttaaggtgaaacctcggcattagaatttttaaatgctatacccagataactggtaaaacatttccgcgtgtgtctgtgagggtgttcccagaagaaattagcatttsaatcagtagactgagtgaaaaagattctccctcaccaatgtaggtgggcatcatccaatccactaagggcccaaacagaacaaaaaggcagaggaagagcatatattgctctctcttcggaagctgggacatccatcttctccctcctctgagacaacagaacttcaaatactcagatccttggattctaggactcacaccagcaaatctcccatttctcaggccttcagcctcagactgaattacaccacaggttttcctgttctccagcttgaagatggcagactgtgggacctcttg

SEQ ID NO: 9101 - DNA, 601 bp, Human
aaaaaaatcaatggggtttggtaacacactagatggaggaaggagaataaatgtcagaatttgaatataaatcaagtagaagcatcaagtacttctaatatgattggcagtggttctcaaccttggccacacactgcagtcatttgggagctttaacaaatactaatacctgggtcccaatccctgagattctgatttaaggtgaaacctcggcattagaatttttaaatgctatacccagataactggtaaaacatttccgcgtgtgtctgtgagggtgttcccagaagaaattagcatytgaatcagtagactgagtgaaaaagattctccctcaccaatgtaggtgggcatcatccaatccactaagggcccaaacagaacaaaaaggcagaggaagagcatatattgctctctcttcggaagctgggacatccatcttctccctcctctgagacaacagaacttcaaatactcagatccttggattctaggactcacaccagcaaatctcccatttctcaggccttcagcctcagactgaattacaccacaggttttcctgttctccagcttgaagatggcagactgtgggacctct

SEQ ID NO: 9102 - DNA, 601 bp, Human
gacctactgaattcagaatctgcattttaacaaaatccccaggtgattcctatgcacaacacagttttagaagcactgatttagaaagctgtgttttaggcaaatttccaggcagtgatatgtagaatggactaaagggaaattgactgcaaggatagaaacaccttacaagaacatttaaaaaccttaggcattacttcaaaatctgaatcatggtgcatgcaggtagcacgaataaaaagaaaaaaatattgaaatcagaaacattctaatgaaaaaaatcaatggggtttggtaacasactagatggaggaaggagaataaatgtcagaatttgaatataaatcaagtagaagcatcaagtacttctaatatgattggcagtggttctcaaccttggccacacactgcagtcatttgggagctttaacaaatactaatacctgggtcccaatccctgagattctgatttaaggtgaaacctcggcattagaatttttaaatgctatacccagataactggtaaaacatttccgcgtgtgtctgtgagggtgttcccagaagaaattagcatttgaatcagtagactgagtgaaaaaga

SEQ ID NO: 9103 - DNA, 601 bp, Human
aaatagagaaaaacatgtttctcttaagtttaaagtttcttagagggtaatcaatagactatgtcaggggctgtgttgggatcccagttagctgagtactggctttggtcccagttagctgattattatgtggctaatgacctcttcatgcagctcttattccttgtctctctttaaagctctattagttctacatctccttttaaagaatagtagctgatgcacttccagtgtgccaggaactacgttaaacccttcactcacatgaatgcatttaatcttcccaataaccctttaaggyagatccttttattgccctcattttgcagatgaggaaactgaagatcaaagggattaaccagttccatcctggtttgtcagccagcaactaagtggtaaagatgggattcaagcccagagcaagcaatcttaataattagtccccaaagcctccctgcaactttccattttggtttaaaattttcacgacaaagagtagttatgtgtacataaaaagcaaacactactctgagtttgtttatacagatataaatttaaagataattctggaagtcaaatattgcaccttgttagtggcctg

SEQ ID NO: 9104 - DNA, 601 bp, Human
attctctagaagggagtagggagaggggaagattgcaaaaacttaacctctatgatttttttcaaaaattaccatcacagatgtttagtaatatctatgatccttacttgtaaaaaaagcactgctgtatctataacagttatggttataacattaatgaaaagaactcccaaacatttttaattagttgaaatactttacaagaataagaggcaaataaagagcttagatatttcagtgaatcttaaaaatcttcctgcattttccggcctatgttataattcagactttagtattcagyagtcaactactccattaaaacagctttccagagttggtaccaatgtctttaaaaaccagtgtcactgaaaggtaccaggatattttgtaaacaatcaatatttaatgattcaataatcacagttctttttaggttccttggtaattagtcagaatgggtattggcttactcgataagggtggacttagaaaaagagaaaacaccaaattcattttgccttatttatgaggaaaaatagagaaaaacatgtttctcttaagtttaaagtttcttagagggtaatcaatagactatgtcagg

SEQ ID NO: 9105 - DNA, 601 bp, Human
tgatcttttaccacgttgtaatgaatttatcctaaatccttgattttaactgccatatttgcatcaaagaattgcaagtatatcactaagtatgataaaataaaatcaagatgataagataaaaagagagaaggaggaaagagctctgattccaaactgaatttctacttaataactggagttgacattcaacaatggtggttcagcctagcctgaaagacattattggatataatctctagttcatatcagtaagaaattttcagagaaaattcttgaggaattcagagaaatttcagakaattcagagaattcagagaaatttcagagaaataagaaatttgcattatttcataaagtcctgctttctaccccttatcctctcctccccaaataatctagagaaaaaaaaaaatcagtaggcccagagtgacaaatagggctctgagtaagagttaatatttagggttggttatatcagtgaagccactataaataaaaaagaacactcatcttcactatgtcagaacaagcaatacttcaggggagggcagtatttcacaaacaggtcatctgagctagggggaaagatctgagcttc

SEQ ID NO: 9106 - DNA, 601 bp, Human
cttagcctcccaaagtgcttggattacaggcgtgagccaccgcgcctagcctacctctccaaattgaaaaaaatttaaaagcaagtatcttctttgcttcattaaaaaaaaaaaaaaaagaatctacaaagtgcagtgattcagcagttacttgtcaaaacaagataatttaggagaaataaatgaaaatatttttaaatgagcagacacaatcataaaacttaaattctaaaaaacatttatttttgtattttgtagttggaattacatatctgatttcatgaatgcctcaatttatgartttcggtaggtgttaatcacttggattcgccaaagtataaatctcataaaaattagctgatactttttgaatctttttagtttttaaaaggaagatatacgctaaaatgctaagatattagctaaaatgatcttttaccacgttgtaatgaatttatcctaaatccttgattttaactgccatatttgcatcaaagaattgcaagtatatcactaagtatgataaaataaaatcaagatgataagataaaaagagagaaggaggaaagagctctgattccaaactgaatttctacttaat

SEQ ID NO: 9107 - DNA, 601 bp, Human
caaattttcttatcattaaaaataggataccatttgggtacacaaagcctaccacattaatttaatcttcagtttcaagtttttattcactttctttttcttcttgatcagtaatgtagacttggggatttcacatattagcacagtgtttttcatctgctgctcttaagaaacattcttcttttaggaaagcagttaacatcttcataatatatactttgttatttaaagggcagtgtgcagaaggaaaaagaaaggattgtcactatcacaacctcaagtccagaacaaacagaaactytgcgcagcacttttgtttctaaaacaaaactacaagaaagaatactgtggggaataaatgcagtgaacaatttgtaacttttcctttttttttttttttttcaggctggcatgcagtggcaagatctcggctcactgcaacctccacctccctggttcacgcaattcccctgcctcagcctcctgagtagctgggattacaggtgcatgccaccacacccggctaatttttttgtatttttttttttttttgagacggagtctcgctctgtcgcccaggccggactgcggactgcagtgg

SEQ ID NO: 9108 - DNA, 601 bp, Human
atgagcattccctgtgaatattaagtagtgagtacttatattacgtgcaaacagagatcttatgtagaactgttagtatttgtggcataatattttaaaagtcttggccgggtgcggtggctcacgcctgtaatcccagcaatttgggaggccgaggtgggcggatcacaaggtcaggagtttgagacctgcctggccaacacagtgaaaccccatctctactaaaaatacaaaaaattagccaggtgtggtggtgggcacctgtaattccagctattcgggaggctgaggcaggagaatygcttgaacccgggaggtgggggttgcagtgagctgagatcatgccactgcactccagcctgggcgacaagagtgaaactctgtctcaaaaaaaaaaaaaaaagtcttttaatacctcaatagtttgccaccatacaaagaggcaaacatcttctcttttttccttagtgttccctttttcatgctctacttcctcttttccctctgatttaagacaaccttgaacaccaatttttgtataaacctttgtgtaaacccagtctatatcgcttctcctctggtagttcacaacattttttag

SEQ ID NO: 9109 - DNA, 601 bp, Human
tgtctgacctcatttccaggcacttccctccttctagtggatgctcaaacagtgtagcaaagtaatagacatattccctctgctctcagtctgtcaacagaggcagaaaacgatggtgcagaaagatataatagagacagaccaatgagcattccctgtgaatattaagtagtgagtacttatattacgtgcaaacagagatcttatgtagaactgttagtatttgtggcataatattttaaaagtcttggccgggtgcggtggctcacgcctgtaatcccagcaatttgggaggccgagrtgggcggatcacaaggtcaggagtttgagacctgcctggccaacacagtgaaaccccatctctactaaaaatacaaaaaattagccaggtgtggtggtgggcacctgtaattccagctattcgggaggctgaggcaggagaatcgcttgaacccgggaggtgggggttgcagtgagctgagatcatgccactgcactccagcctgggcgacaagagtgaaactctgtctcaaaaaaaaaaaaaaaagtcttttaatacctcaatagtttgccaccatacaaagaggcaaacatcttctct

SEQ ID NO: 9110 - DNA, 601 bp, Human
tcttcaccttgcacttttgtgttatgcagatggcttctttccgtaaacctcacgagacaacctctgctagcttctaacttttcttctgaagcttccttacctctctcagccttcacagtattaaagaagttagggtctcactctggattgggctttggcttaagagaatgttgtgactggcttgatctatccagaccattcaaactttgtatcagcaataaggctatttgactttcttagcactcatgtattcattggagtggcacttacagtctccttcaataacttttcctttgtgtcyacaacttggctaactggcccaagaatcctagtttttggcctatcttggctttcaacatgccttcctcactaagcttattcatttctagcttttgatttaaagtgaacacttgaacacttagagaacactatagggttatcaactggcttaattataatactgttgtctctcagggaatagggaggccaaaggagaaggagagagacaggggaacatgaagaaggtgaaagctttggtgaagtatgttcaagagagaatggaaggaaatggaaatggcaaacatggcctgtataactcttt

SEQ ID NO: 9111 - DNA, 601 bp, Human
aaacgacattgatttccttgtgcatctccatctgagctcctgggtgactaggtgtactgtcacagagcagtaatattttgaaagaaatcattttccctgagcactaggtctcaatagtaggcttaaaatattcagtaaatcatgctgtaaacaaaggtgctgtcatctaggctttgttgttccatttgcagaggacaggctgagttgaattagcataattcttaagggccctaggatttttagaatggtaagtgagcactggcttctgcttaaattcaccagctgcattagcccataacawcagagtcggcctatcctttgatgctttgaagccagacattgacttctcctctctggctatgaaagtctgaaatggcatcttcttctaatagtagtctgtttagtctacattgacaatctgttgtttagcatagccaccttcatcaatgatcttcactagatctggataacttgctaaagcttctccatcagtacttgcttcttcaccttgcacttttgtgttatgcagatggcttctttccgtaaacctcacgagacaacctctgctagcttctaacttttcttctgaagcttccttacc

SEQ ID NO: 9112 - DNA, 601 bp, Human
tgtaggcatgcctcagagatattgtgggtttggtttcagacaatggcaataaagcgagttacacagatattttggtttcccagaggatataaaagttatttttagactatactgtaatttcttaagtgtgcaatagcactatgtctaaaaaacaatgtacataccataattaaaaaatactttattgctgaaaaatggtaacaatcaccttagtctttagctagctataaactttttgctggtgaagggtcttaactttgatgttgatggctgccgaatgatcagggtggtggttgctgamggacggggctgttgtggaaatttcttagcataagacaacaatgaagttgccaccacggattgactcttcctttcatgatagattcctctgtagcatgtgatgctgtttgatagcattttacccacagtagaacttctttcaaaattggagtcaatcttttcaaggcgtgccactgctttatcaactaagtttatgtaatattctaaatcctttgctgtctttcaacaatattcacagcatttacagcagggatagagtccatctcaagaaaccactttctttgctcatctataagaagca

SEQ ID NO: 9113 - DNA, 601 bp, Human
gccagttaatatacaatgaagtatttgtaggcatgcctcagagatattgtgggtttggtttcagacaatggcaataaagcgagttacacagatattttggtttcccagaggatataaaagttatttttagactatactgtaatttcttaagtgtgcaatagcactatgtctaaaaaacaatgtacataccataattaaaaaatactttattgctgaaaaatggtaacaatcaccttagtctttagctagctataaactttttgctggtgaagggtcttaactttgatgttgatggctgccraatgatcagggtggtggttgctgacggacggggctgttgtggaaatttcttagcataagacaacaatgaagttgccaccacggattgactcttcctttcatgatagattcctctgtagcatgtgatgctgtttgatagcattttacccacagtagaacttctttcaaaattggagtcaatcttttcaaggcgtgccactgctttatcaactaagtttatgtaatattctaaatcctttgctgtctttcaacaatattcacagcatttacagcagggatagagtccatctcaagaaaccac

SEQ ID NO: 9114 - DNA, 601 bp, Human
ttaccccggacggtgtttttggatttggagtctgttaaatcaggatcaagcttgttccatcattgcctgtacttattatgagtccatgtctctatagccttgtaaaatgtcctgccaataaagcttcctgataattacagtatagagtggtgtgcccataatgggcacctactacaaacataaaagaagtaacacagcaaaaatggtaaaaagcaagttttgtgcatcaaaacactaaataggctgaatagaatttaaaaattaaagttggtatcaaaggggttgagagaatgccttcttyactagagctgaactaagtgtctggatcactgctgttgcctctactggtctagctaaccacatatgtagccactgaaagctagatatccatataatttaacataagatattcaagaaaaacatgtgtgtgtgcgtgtatatatatgtacatacataatttctttacattctaagtccttcatatggagaacatagtttattatgttctcatagccaaaacataatttcatctcaaaatattttccctccaaatggaagatgtgcctgagaagctaatcatgcatgaaagcacagatgcaga

SEQ ID NO: 9115 - DNA, 601 bp, Human
gacatggataaagctggaaaccatcattctcagcaaactatcacaaggacaaaaaaaccaaacactgcatgttctcactcataggtgggaattgaacaatgagaacacatggacacaggaaggggaacatcacactctggggcctgttgtggggtggggggagtggggagggatagcatttggagatatacctaatgttaaatgatgagttactgggtgcagcacaccaacatggcacatgtatacatatgtaactaacctgcatgttgtgcacatgtaccctaaaacttaaagtataataaaaaaaaaaaagatctgtgagtttcactgtacgtgaattttaaaacattttaaaagcaaatgaatatgtaattgctgaaggtatgtgaaagtggaggcccatgtgccaagttcccagctgtctgggtaatgttgaagcaggctgaagtcctgatcatttgttctgtgctattagggaggacgtcgctccccagacggggccagggcaaatccagcctctgggggtcagtagctgtcctgccccaggaacatcctgtgggactagagtcaacctgagactggggttcttccccacgaggga

SEQ ID NO: 9116 - DNA, 601 bp, Human
agacaatccaaagtggctgctaaaagctggtttcttggacttagattataagtctcgtaacaagttttcacagccaagaaccacttatgcaacattaaaaaaaatcctatgtatcaaggaaaagtgaataataatgcagtatcaaaaataagtagattcttcaagaaaaagcaaaactaatttgtggttatagatatcagaacagtgttgcccatgggtggtgaggactgattagggaattagttatacagatatatgtacatttttcaaaactcatcaaattgttcattaagatctgatraatggctaactagaataaccaatgcagagaagtccttaaaggaccggatggagctgaaaaccaaggcacgagaactacgtgatgaatgcacaagcctcagtagccgattcgatcaactggaagaaagggtatcagtgatggaagatcaaatgaatgaaatgaagtgagaagagacgtttagagaaaaaagaataaaaagaaacgaacaaagcctccaagaaatatgggactatgtgaaaagaccaaatctatgtctgactggtgtacctgaaagtgacagggagaatagaaccaagttgg

SEQ ID NO: 9117 - DNA, 601 bp, Human
aaactttattttcttaataagccattaattatggagttgaaacttatagcctaaggcgacactggaagagagaagaaagaaaagcttgagattatttaatttttaatttaaaaagtatagaaaatcacaaagaatgagacagtaaacatccatgcctttgccatctaaaacagtgttagtgtgagacttgttaaaacacagtttcgtgggtctaccccccaaatttcagattttgtagatctagactggggcctgtatttctaaaagttctcagatgattacaaatgctgctggtccaggsacaaaagacgcattgacaactactgatacagaattactaaatgttaatatttggtgatgtttcctttattaatactattaaattaagataaaattaaattggacttcctctttccagtctttcttctcccccctgttcctcctaccatagtcaaccttcttcattatactgttaaaaatacataaatctatacacaaaacatagtacttttatctttcaaaaaggtttcttaaatgaaataatatataggaatcattttgcaacttgcaattatattcaatgttgttttttaagatcaat

SEQ ID NO: 9118 - DNA, 601 bp, Human
ttaaatcaagtaactgttaactataggctttgaaatgtccatttttaatgacagcttttactctaagtatatctcagactccatgtgagaggcagcacccctaaaagcattagcttccatatcagaatgtccattcacttttgcctacctgctggctaactgtactctcagatacgggcactccacgctatttctgtaaaagcgcaaaaaagcctttctgttttctattttactggcactatgcacagcacaaatggatgttatgtcctcacagggtcgagtgttcttttaggaatgcaarggccaagacttgactctcactgggcgagcagtatggaatgtgacagctggttgtttcagggcaactgatcattgccacagtgagcaatttcttcttcaataagcagctgccccagacatttactgaggtcatacatcaatcccaatacatttccccatccccggttcaggggatgctcagcatggaaactaaaagcaaaggaggaaaggacagactacaaatcatagctatccctctctctcagcctcagaagatctccactgcaatgacaggactctagacagtctaatctgagccaaa

SEQ ID NO: 9119 - DNA, 601 bp, Human
ctcaagcaatcctcctgctctggcctcccaaagtgctgggattacaaacatacagtaagatagaagaaataaattaaatgttttatagtataggagggtgactatacttaacaaaaatgtattgtattaggggtaatagacaccagaaataccctcatttgatcactatgcattatatacatgtaacaaagtttcacatataccctgtaaatttgtaccaataaataaagaaatattaaaaaaaaaacaagttctgtcaagagactattagaccaggaaaatatagttggtcctttgtatmcaactgtgatagaaaatgtttgacaaaaaaattttaaacccacagcaataaaaataacataaaataaatatagtaggacaattacgtacagagcactcacattatattaggtagtataagtaatctaggggtgtgctcagagcagggggctgaagaatggctcctctgtttataacacatggaacaggcatctgaggtcactgtgacaaggggcacaaaacttgtgactccctaagaacaaatgtcctacaagtgtaacaaaaaaaagtaatccagaggtgatttacagtgtatgagagg

SEQ ID NO: 9120 - DNA, 601 bp, Human
ttaaaaatttttttgtagagatgaggtctcactatgcccaggctggtctcactatgccctgcactcaagcaatcctcctgctctggcctcccaaagtgctgggattacaaacatacagtaagatagaagaaataaattaaatgttttatagtataggagggtgactatacttaacaaaaatgtattgtattaggggtaatagacaccagaaataccctcatttgatcactatgcattatatacatgtaacaaagtttcacatataccctgtaaatttgtaccaataaataaagaaatattaaaaaaaaaacaagttctgtcaagagactattagaccaggaaaatatagttggtcctttgtatccaactgtgatagaaaatgtttgacaaaaaaattttaaacccacagcaataaaaataacataaaataaatatagtaggacaattacgtacagagcactcacattatattaggtagtataagtaatctaggggtgtgctcagagcagggggctgaagaatggctcctctgtttataacacatggaacaggcatctgaggtcactgtgacaaggggcacaaaacttgtgactccctaaga

SEQ ID NO: 9121 - DNA, 601 bp, Human
tattctccaacctcagcttccaagcagctgggactacttggaaggcatgtactaccatgcctggttaaattttaaaaatttttttgtagagatgaggtctcactatgcccaggctggtctcactatgccctgcactcaagcaatcctcctgctctggcctcccaaagtgctgggattacaaacatacagtaagatagaagaaataaattaaatgttttatagtataggagggtgactatacttaacaaaaatgtattgtattaggggtaatagacaccagaaataccctcatttgatcacyatgcattatatacatgtaacaaagtttcacatataccctgtaaatttgtaccaataaataaagaaatattaaaaaaaaaacaagttctgtcaagagactattagaccaggaaaatatagttggtcctttgtatccaactgtgatagaaaatgtttgacaaaaaaattttaaacccacagcaataaaaataacataaaataaatatagtaggacaattacgtacagagcactcacattatattaggtagtataagtaatctaggggtgtgctcagagcagggggctgaagaatggctcctc

SEQ ID NO: 9122 - DNA, 601 bp, Human
ttctttttgagacagggtcttgctctgttgcccaggctggagtacagtggcacaatcacagctcactgcaggcttgatcttcgaggctgaggctattctccaacctcagcttccaagcagctgggactacttggaaggcatgtactaccatgcctggttaaattttaaaaatttttttgtagagatgaggtctcactatgcccaggctggtctcactatgccctgcactcaagcaatcctcctgctctggcctcccaaagtgctgggattacaaacatacagtaagatagaagaaataaawtaaatgttttatagtataggagggtgactatacttaacaaaaatgtattgtattaggggtaatagacaccagaaataccctcatttgatcactatgcattatatacatgtaacaaagtttcacatataccctgtaaatttgtaccaataaataaagaaatattaaaaaaaaaacaagttctgtcaagagactattagaccaggaaaatatagttggtcctttgtatccaactgtgatagaaaatgtttgacaaaaaaattttaaacccacagcaataaaaataacataaaataaatatag

SEQ ID NO: 9123 - DNA, 601 bp, Human
tactctgaacgagctcagaatcaagaatgagtgatacataaacatagacttatagcgtagtaggatggtgggatcagtttcatgatacagtggccatggattgctaggagcactgaaggggcacttaatgtgggtaaaagagaaggagtctcagaaatgacatttaaattttttttctctaataaatagttttacaaagtaaagacataaactttaaatctgtgttttaagaaagatgagtttcaaacagatatagaaagtattatgcaaagtttctgataaatatgcagtacaaaaagtrtacattgatatgctatctgtacctggaactgtatgaagcaatgtactaagcaagaaaataaagagaaagctcctgctcactcaaaaatataagaagacaaaaaatcagctgcttattaaatgatcactaatcaaactatattaacattttagtccatcatcatatcaacataaatttacagtgagatgatgattcctttcagtcttttttttttttttctttttgagacagggtcttgctctgttgcccaggctggagtacagtggcacaatcacagctcactgcaggcttgatcttcga

SEQ ID NO: 9124 - DNA, 601 bp, Human
aattggctcatgtctgacacaagttttggtaccttttcatctttttcagtaaatgtcccaccgtttcctgatttcttgttgatggcctgggctacaccaacaacctggtataaggagagaaaagcgacaatttttttattgactgaaattacttgtaaaaattcaccaaaatgtatttatagaagatatcctgcatgtgctttaaaataacactagtctacaaaacaaaagcaaaacccctcatcagcatttgagcaagctttacatcatttaccacattctttcatcctaataagaattygaatgtttttaatttattagggcccaaactatgtttgatcctgtgatttcaccctgcattttgaatgaaattattttagcaatcacattttaagtatatattttccatagtttttaaatataaacaacacattttgattacagttccaataaagtatataagaatatgaacattttatatgggttttaaatataatattccaaaacggctaaatgctcttttactaaaaatgaaacaggacctagtggccaatcatggaaagaatgcaggaggatcattagggcaaaaataattcttaat

SEQ ID NO: 9125 - DNA, 601 bp, Human; identical to SEQ ID NO: 1438

SEQ ID NO: 9126 - DNA, 601 bp, Human; identical to SEQ ID NO: 1439

SEQ ID NO: 9127 - DNA, 601 bp, Human; identical to SEQ ID NO: 1440

SEQ ID NO: 9128 - DNA, 601 bp, Human; identical to SEQ ID NO: 1441

SEQ ID NO: 9129 - DNA, 601 bp, Human; identical to SEQ ID NO: 1442

SEQ ID NO: 9130 - DNA, 601 bp, Human; identical to SEQ ID NO: 1443

SEQ ID NO: 9131 - DNA, 601 bp, Human; identical to SEQ ID NO: 1444

SEQ ID NO: 9132 - DNA, 601 bp, Human; identical to SEQ ID NO: 1445

SEQ ID NO: 9133 - DNA, 601 bp, Human; identical to SEQ ID NO: 1446

SEQ ID NO: 9134 - DNA, 601 bp, Human; identical to SEQ ID NO: 1447

SEQ ID NO: 9135 - DNA, 601 bp, Human; identical to SEQ ID NO: 1448

SEQ ID NO: 9136 - DNA, 601 bp, Human; identical to SEQ ID NO: 1449

SEQ ID NO: 9137 - DNA, 601 bp, Human; identical to SEQ ID NO: 1450

SEQ ID NO: 9138 - DNA, 601 bp, Human; identical to SEQ ID NO: 1451

SEQ ID NO: 9139 - DNA, 601 bp, Human; identical to SEQ ID NO: 1452

SEQ ID NO: 9140 - DNA, 601 bp, Human; identical to SEQ ID NO: 1453

SEQ ID NO: 9141 - DNA, 601 bp, Human; identical to SEQ ID NO: 1454

SEQ ID NO: 9142 - DNA, 601 bp, Human; identical to SEQ ID NO: 1455

SEQ ID NO: 9143 - DNA, 601 bp, Human; identical to SEQ ID NO: 1456

SEQ ID NO: 9144 - DNA, 601 bp, Human; identical to SEQ ID NO: 1457

SEQ ID NO: 9145 - DNA, 601 bp, Human; identical to SEQ ID NO: 1458

SEQ ID NO: 9146 - DNA, 601 bp, Human; identical to SEQ ID NO: 1459

SEQ ID NO: 9147 - DNA, 601 bp, Human; identical to SEQ ID NO: 1460

SEQ ID NO: 9148 - DNA, 601 bp, Human; identical to SEQ ID NO: 1461

SEQ ID NO: 9149 - DNA, 601 bp, Human; identical to SEQ ID NO: 1462

SEQ ID NO: 9150 - DNA, 601 bp, Human; identical to SEQ ID NO: 1463

SEQ ID NO: 9151 - DNA, 601 bp, Human; identical to SEQ ID NO: 1464

SEQ ID NO: 9152 - DNA, 601 bp, Human; identical to SEQ ID NO: 1465

SEQ ID NO: 9153 - DNA, 601 bp, Human; identical to SEQ ID NO: 1466

SEQ ID NO: 9154 - DNA, 601 bp, Human; identical to SEQ ID NO: 1467

SEQ ID NO: 9155 - DNA, 601 bp, Human; identical to SEQ ID NO: 1468

SEQ ID NO: 9156 - DNA, 601 bp, Human; identical to SEQ ID NO: 1469

SEQ ID NO: 9157 - DNA, 601 bp, Human; identical to SEQ ID NO: 1470

SEQ ID NO: 9158 - DNA, 601 bp, Human; identical to SEQ ID NO: 1471

SEQ ID NO: 9159 - DNA, 601 bp, Human; identical to SEQ ID NO: 1472

SEQ ID NO: 9160 - DNA, 601 bp, Human; identical to SEQ ID NO: 1473

SEQ ID NO: 9161 - DNA, 601 bp, Human; identical to SEQ ID NO: 1474

SEQ ID NO: 9162 - DNA, 601 bp, Human; identical to SEQ ID NO: 1475

SEQ ID NO: 9163 - DNA, 601 bp, Human; identical to SEQ ID NO: 1476

SEQ ID NO: 9164 - DNA, 601 bp, Human
acaaagagtttagcatgtggcaaactatgatgaggatgacagaaaaagactctcaatgatctgttcacacttttctcattccttacataactgttgtcacaactcacatggcccttacctatgtcatcgcaaatacatttaaacacaggaggacaacctaggttgtaaagtgttaaagtgcctcaaattttcattaatctcaaccaagccattccaaaccaagacctacaacatacatctacttacatatccatgtgcttttctctcattgtatgctaaataatgcaaagagaattcaggwactgaccttatttgaccccaatttcaaacagcattttataagccatatggtcagaaattaaaatcactctcaattcttgataatacagagtaggtatcagtaacaaactataaattgttttgttattaccctagccaaacaaccacctcatggtccccatttctccaggaactaaaagaaaagtaaatttaattttggccccaaaaagatgtaatgattataacaattactggaaaacaaatatcagaatcatacactatattacacagtcagtataagttatttaatgccttttgcttt

SEQ ID NO: 9165 - DNA, 601 bp, Human
gaatcaaatatttacttcctagtttttcagataataaataagcacttattatattctgataattaattaactttctaataaccataacaggtcagccggggtccttttattattatctccgcaacttgcaactaaggatcattaaaagatatatgcaaaatgctcagtttaacacctaatttatgctacacccaattttaagccaagagaaggttagatttataatgggatacaacactcaagcaacagaagtggaaaaaataaagattctgaatttcctatccactaattactttgttayaactggagaaatttttctggacacaggcgtaaatatttagtagatttaattctcttaagaataaatttgttaaaataaaaattaagaaaatatttgatagcttttccatttattttgggttttaaattgagataaccagacaaacgacagcaattttggtgattgctggatgatacaaacacctgtgtagctagggctgtacaggcatttttatttggttgacagacaactagaactgaaatcagttgctgaatttcaaccaatttaagtgaattacttgacctacaagctatgtaaccc

SEQ ID NO: 9166 - DNA, 601 bp, Human
atttctaggactgtttgaggaagatgatgccttggggcttcccaaccactgagttgtggactggtacccgaccgtggctggttaggaaccaggccacatagcaggaggtggtgagtagtgggagtgagaattactgcctgagctctgcctcctgtcagatcagtgacagcattagattctcataggagcatgagaactgtacatgtgagggatctcggttgcatgctccttatgagaatctaatgcctgatgatctgaggtgaaacagtttcatcccaaaactattcccatactgactatrtctccattccgcccgccccccaacccaacccctggaaaaattgtcttccacaaaatcagtccctggtgccaaaaaggttgggtaccactgccttactggatgccataggtaattacagttcagtgatagtggttatcaagatagtcgggccaatacttctttgttaaattatctgctcaaaatttttccatttataatctggccatccatacagagttttcaaaaaatgaaggaatatgatggtcatcttgacataaggaacttgatcagtgccataacactgacttaggcatcagagat

SEQ ID NO: 9167 - DNA, 601 bp, Human
ttttgttatattgctccttggtatttattcaatataaatggtccacaggaaaaaaggtttcaatctcaataatccatttttaaagaaattatttttattatatatttgatgggttatatcagtggctgtaaggagacatctcctgccaggtgttttaagcccttcttattggctctgaccaccactcctacctcacaggatacttcttaatggagagcagtttaattccaggtctttgaataaagccaccttgacagctgccacattacaccttatggaagaccattatctcttttctccrctttccgcatgcccaagaggggtgtttttaaagaagaaaccacacaattagtttataaggcttttagaatttatctttttcgaagagggaagtgaatccaaagacagataagaaagaaaactacttttaaaacgggaatgagtatgaaattcagtaaatcttgcagacagtaaagaaatgaatcaggcacagtgggactggactagtatattttctttaataacagcatcaacatgttatatgatttttcctttttttctaacattatataagtgaatccctttaaatctcaataagaaa

SEQ ID NO: 9168 - DNA, 601 bp, Human
cttgctgtgtcagagagattaaagaaagaaaatgaagggctctgggctttaaatttttggctcaaataatggtctgaaaactagagaagttttatggctttcctaaaacagcctatttcttgtagtactgatgtagccaaaacccaagtgtagtcttatcctacaggttggtgaattacagtgtaggttgaaatcacagacttgccacatctcctatgtgaaagttaaagcactgattaggaaggagtggagcaccaagaaatgaaattgagacatatgaaaagatctggataatgacatrtatcttagaccattcactctagaatatgtttctatgtaatttcacaatgttttatactttacagtcccacctctttttcctaattgtaattatacaaattgtataattatcttatatatgactttttattcactgttatatttggagcacctaatataatgcctgcatagaataggggttaaatattgaatgaataaataaatgggtttttaaatcatctagtacctaatcagtttctccatattatgcagaactatttcatataaatttaatttggcatagagctatagtacagtattc

SEQ ID NO: 9169 - DNA, 601 bp, Human
actgcagtcctgcagcttgcagttctgctagcagctttctgactctggcctatgtatgtagaagtttccatagtgagccagaacagcaattttgttctaggacttattcctgggatgacttacctaccctttccaatgatttgaaagtacttagttaaattcttttctgcttaaaatagctacagtagttcctactacctgcagttgaaccctgttgatgctctattttgcaacgaaagcatgtgtaggcaacagactctcaaaagtttgaatatttgacctgatgagtttgaaggcagargggatccgtttccattagagcagcagttctcaaagttaagttcctggaccagcagcatcagcatctgggaacttgttaaaaatgcaaattcttgggtcccaacacagacctactgaatcagaaaccctgggagtggggctcagcaatctgcgttacaaaaaccttccaggtgattctgatgaatgctgaactttgagaaccactgcattagggataggttattggtagtaaatagtagttaacagtcattttaagtgaacagtttagaaaaaaatgcctttttgtggacccagtggtgac

SEQ ID NO: 9170 - DNA, 601 bp, Human
tagatttggtttcggcaatgaggcaaacttgagtgagacttgaatttcaaactaatgtagtgacacatgggaaactcattattttggggggacgtgactctagagggaatactgcagtcctgcagcttgcagttctgctagcagctttctgactctggcctatgtatgtagaagtttccatagtgagccagaacagcaattttgttctaggacttattcctgggatgacttacctaccctttccaatgatttgaaagtacttagttaaattcttttctgcttaaaatagctacagtagttsctactacctgcagttgaaccctgttgatgctctattttgcaacgaaagcatgtgtaggcaacagactctcaaaagtttgaatatttgacctgatgagtttgaaggcagaggggatccgtttccattagagcagcagttctcaaagttaagttcctggaccagcagcatcagcatctgggaacttgttaaaaatgcaaattcttgggtcccaacacagacctactgaatcagaaaccctgggagtggggctcagcaatctgcgttacaaaaaccttccaggtgattctgatgaatgctgaa

SEQ ID NO: 9171 - DNA, 601 bp, Human
tcactttggtcctgcttcctcacaggtaggaggagggatatttcacagctcctggcttaaatggaggaccctagcctctactgggttaaagtagtggagggttagactcaatatgtggtagcctctcttcttattgcaataatgttctaaattttaaaaactgacttttctgaaattgtcatttttttttttcagggatgggggaagtgtctatgtatttgtcatctgtttttaaggttaattaataatctctctcacaagagagaaaaagaaggctctcttccaggcctctttgtttctyctctgcctagaatgcatattcccatgttttcacgtagctaattctttaactttttttatgtctcagctgcatcagggaaacattcactagtccttgtgatagcaaggctccattaacatctgtttcaacctttttctagtgagtcttcatcttccgaagaggctagacagctaacaaaaatacatttccttgactctcttgcaacttggattccagatagatttggtttcggcaatgaggcaaacttgagtgagacttgaatttcaaactaatgtagtgacacatgggaaactcattatt

SEQ ID NO: 9172 - DNA, 601 bp, Human
tcaattgtatctgccactcaaactaataaactagtgggcctctagtgactctttaaaggaattatatcataagtctttttatgatccttttctaataccatggccctcttttcaccattcttgcaaaaattaaaaattaaaaaaaattcaactctggacatgaaaagtcactaagagtggaacgagagttaatctttgagtgcaggaatgtcttgagttaaagcagtagtgagagttataaaaatattttaattttgcagtgaccttaaaactaattgttctaaataccatctaactgataagctaaatagtaaactgatgtgcagctgacaaaatgctagatcaactaccatatttacatttcagcatgagatgatgatcagaaacagaaacttaaaaggaaggtgaagcaagtgataaaaaggaatgtcggctattgggggtgctagtccagatgttccactgactttgtcaccctgaacaagatgttcaatctctctgcctgcttttttgaacgtgtaaaagaaggaagttggagtagactatctctaaggtttaacattctctgatatattaatacatttatctctgtatccacagg

SEQ ID NO: 9173 - DNA, 601 bp, Human
ttaagctcttacaggactatggttttaatgtcaaattaaccaaatatggaatgcaaaaaaaaataaaaaaacaaagctcattgggttaaagattcaatctgacaaacaatttgatggtatatgtattcttctgagttcttcaattgtatctgccactcaaactaataaactagtgggcctctagtgactctttaaaggaattatatcataagtctttttatgatccttttctaataccatggccctcttttcaccattcttgcaaaaattaaaaattaaaaaaaattcaactctggacatraaaagtcactaagagtggaacgagagttaatctttgagtgcaggaatgtcttgagttaaagcagtagtgagagttataaaaatattttaattttgcagtgaccttaaaactaattgttctaaataccatctaactgatgagctaaatagtaaactgatgtgcagctgacaaaatgctagatcaactaccatatttacatttcagcatgagatgatgatcagaaacagaaacttaaaaggaaggtgaagcaagtgataaaaaggaatgtcggctattgggggtgctagtccagatgttcca

SEQ ID NO: 9174 - DNA, 601 bp, Human
ggaagactatcctgtgcccagactagcagaacctgcctcccaccatacttgcctcacacaagcctgatcataagaatcacctgggtgcctattaaaaaacattcatttggaccaaggagccctggctccctcagactgagcagagcgcacaggctcctctcctagatgttttgctgggccctgtgggatgggaatttaaaggaacctccactcctctgaccttggaccatttaccctgtcagcactttgttaactgttttagctagatcaggctattaactggaccaacggaggcctttaygtggtttgaagtagagggaagaaaaattaaatttcagccaggttctcaaaccccttaagtttcctatgagtatctgagatagcactactttgcttttgggaagtcaaaaggtcaaaataataaaatcttatggagcaatctaaagtagatttccctacaaatctgaaggcacttgcacattctcctttttattctggacttcagatttcacttacatataccagacttgtttaaactttccatgaatgtcaccctcttcattcaagctaagaattttttcccaagaccaaaactgaccag

SEQ ID NO: 9175 - DNA, 601 bp, Human
gaacttaagcacaaagaggttaattttcttgccagtggcagcccagctagttaaggaatgaggatgccaggcctccagtccaggaagactatcctgtgcccagactagcagaacctgcctcccaccatacttgcctcacacaagcctgatcataagaatcacctgggtgcctattaaaaaacattcatttggaccaaggagccctggctccctcagactgagcagagcgcacaggctcctctcctagatgttttgctgggccctgtgggatgggaatttaaaggaacctccactcctctgmccttggaccatttaccctgtcagcactttgttaactgttttagctagatcaggctattaactggaccaacggaggcctttacgtggtttgaagtagagggaagaaaaattaaatttcagccaggttctcaaaccccttaagtttcctatgagtatctgagatagcactactttgcttttgggaagtcaaaaggtcaaaataataaaatcttatggagcaatctaaagtagatttccctacaaatctgaaggcacttgcacattctcctttttattctggacttcagatttcacttacata

SEQ ID NO: 9176 - DNA, 601 bp, Human
aacatccgaattgtacacagtgctgtttccagatcagacagctcaaagtcactgaagctaaagtcagtaattttaagggtctgggcagatggcaccacagcagccttgggtaaggaaagaagaaaaaaaaaatgctgttaattaaagcagcagtgatttgcaaggttttcttgttttgctgcagagaaatagcatattgtggcttttttttcctttttaatgaaagacactagaaacctttttgtacagtggcaactccactctctgcatttttaaaactgagccacataagggtaattartatggttcaaagtaggctaagtggagaaaagggagttgtcacccttagactgtacctggaacagtgagcaacactaagaactcctctagtgatctggctcctttatacctccccagtcttattcactcaaaagaaatttataatttattgagtaaatattctggaaccatcccagtgctctgggctgcaaatcatctggtaagaagggtaatgataatgttctaagcattttatggttagttctcaggacagccttatgaagtggacactctagctccatttttcaagtacaggaactta

SEQ ID NO: 9177 - DNA, 601 bp, Human; identical to SEQ ID NO: 1477

SEQ ID NO: 9178 - DNA, 601 bp, Human; identical to SEQ ID NO: 1478

SEQ ID NO: 9179 - DNA, 601 bp, Human; identical to SEQ ID NO: 1479

SEQ ID NO: 9180 - DNA, 601 bp, Human; identical to SEQ ID NO: 1480

SEQ ID NO: 9181 - DNA, 601 bp, Human; identical to SEQ ID NO: 1481

SEQ ID NO: 9182 - DNA, 601 bp, Human; identical to SEQ ID NO: 1482

SEQ ID NO: 9183 - DNA, 601 bp, Human; identical to SEQ ID NO: 1483

SEQ ID NO: 9184 - DNA, 601 bp, Human; identical to SEQ ID NO: 1484

SEQ ID NO: 9185 - DNA, 601 bp, Human; identical to SEQ ID NO: 1485

SEQ ID NO: 9186 - DNA, 601 bp, Human; identical to SEQ ID NO: 1486

SEQ ID NO: 9187 - DNA, 601 bp, Human; identical to SEQ ID NO: 1487

SEQ ID NO: 9188 - DNA, 601 bp, Human; identical to SEQ ID NO: 1488

SEQ ID NO: 9189 - DNA, 601 bp, Human; identical to SEQ ID NO: 1489

SEQ ID NO: 9190 - DNA, 601 bp, Human; identical to SEQ ID NO: 1490

SEQ ID NO: 9191 - DNA, 601 bp, Human; identical to SEQ ID NO: 1491

SEQ ID NO: 9192 - DNA, 601 bp, Human; identical to SEQ ID NO: 1492

SEQ ID NO: 9193 - DNA, 601 bp, Human; identical to SEQ ID NO: 1493

SEQ ID NO: 9194 - DNA, 601 bp, Human
ataccattcttctacctcccaatcacacatgatataattcacattaaacagtcacatgttgtagaaaaacaatctgtactagaccatatacagattttataaggaggttgccaaaacaggctatataactcttaattcctccccgacactgaggtgttgagggaggcgtgagagtgtgttcccctctacctcaggtaagagagaggggtgtggagttcctgtgtatgtctcctatcatttagtgggtggaggtggggctagagtagacttgtgtctgactcttgtctggaaagtctaaaagcaaggcactcatatcagtaccagtctgttaagaatgttttgatgtttcttacctattctcccttcccattctccaagtatgaagaggtaagaaaccacatggaggttggggagagaggaaggagttagaagaaacacaaggtagggaatgggagaagcctaccagtgcagtaacagaaaacctgaaactttaaatcatgttcaaaatttggactgctacccaggagtacacatttttgtttctgagttgagaactctatactatatgttggaacctaaagtaactagagggcttttactt

SEQ ID NO: 9195 - DNA, 601 bp, Human; identical to SEQ ID NO: 1494

SEQ ID NO: 9196 - DNA, 601 bp, Human; identical to SEQ ID NO: 1495

SEQ ID NO: 9197 - DNA, 601 bp, Human; identical to SEQ ID NO: 1496

SEQ ID NO: 9198 - DNA, 601 bp, Human; identical to SEQ ID NO: 1497

SEQ ID NO: 9199 - DNA, 601 bp, Human; identical to SEQ ID NO: 1498

SEQ ID NO: 9200 - DNA, 601 bp, Human; identical to SEQ ID NO: 1499

SEQ ID NO: 9201 - DNA, 601 bp, Human; identical to SEQ ID NO: 1500

SEQ ID NO: 9202 - DNA, 601 bp, Human; identical to SEQ ID NO: 1501

SEQ ID NO: 9203 - DNA, 601 bp, Human; identical to SEQ ID NO: 1502

SEQ ID NO: 9204 - DNA, 601 bp, Human; identical to SEQ ID NO: 1503

SEQ ID NO: 9205 - DNA, 601 bp, Human; identical to SEQ ID NO: 1504

SEQ ID NO: 9206 - DNA, 601 bp, Human; identical to SEQ ID NO: 1505

SEQ ID NO: 9207 - DNA, 601 bp, Human; identical to SEQ ID NO: 1506

SEQ ID NO: 9208 - DNA, 601 bp, Human; identical to SEQ ID NO: 1507

SEQ ID NO: 9209 - DNA, 601 bp, Human; identical to SEQ ID NO: 1508

SEQ ID NO: 9210 - DNA, 601 bp, Human; identical to SEQ ID NO: 1509

SEQ ID NO: 9211 - DNA, 601 bp, Human; identical to SEQ ID NO: 1510

SEQ ID NO: 9212 - DNA, 601 bp, Human; identical to SEQ ID NO: 1511

SEQ ID NO: 9213 - DNA, 601 bp, Human; identical to SEQ ID NO: 1512

SEQ ID NO: 9214 - DNA, 601 bp, Human; identical to SEQ ID NO: 1513

SEQ ID NO: 9215 - DNA, 601 bp, Human; identical to SEQ ID NO: 1514

SEQ ID NO: 9216 - DNA, 601 bp, Human; identical to SEQ ID NO: 1515

SEQ ID NO: 9217 - DNA, 601 bp, Human; identical to SEQ ID NO: 1516

SEQ ID NO: 9218 - DNA, 601 bp, Human; identical to SEQ ID NO: 1517

SEQ ID NO: 9219 - DNA, 601 bp, Human; identical to SEQ ID NO: 1518

SEQ ID NO: 9220 - DNA, 601 bp, Human; identical to SEQ ID NO: 1519

SEQ ID NO: 9221 - DNA, 601 bp, Human; identical to SEQ ID NO: 1520

SEQ ID NO: 9222 - DNA, 601 bp, Human
gatgcgtccagcattcaccagccctgctgcctgggccaaggcatccgcctgctgctccagagtctcttcctccccgtcaccttccaggctttccaggtgcacagcccagctcggcccccctgtgccctggccatcaggcccacctgtccctgccaggcccatgacccagggaaccagtaagaagagcccggctaattccagccagaggcaggtgggcaggcccaggggggcatccaagtgtggcactttctgcctccccttcggcatcagagcagtggactgcagacaaagaaaaaggatrtggaagagatcaaagagctggtaactgcaggaatctgagagggagatgctgagccatccatgtgttccccctggaagtccctaagccatgccttttaaattgtgaaacatttgatcttctctttttgttcacatttatccctgaccaacagggataagcccccaggtggagtgtgggccagcactaacaccagcggatggcctcccacagcaagacagccaatcctcacgacaccagctaatccagcaggaggtccagttgctcacaggcactgcgagcaacccctgttgccacccacag

SEQ ID NO: 9223 - DNA, 601 bp, Human
gcgattctcctgcctcagcctcccaagtagctgggattacagatgcccgccaccacaccaggctaatttttgtatttttagtagagacagggtttcaccatgttggccaggctggtcttgaactcctgacctcaagtgatccatccgccttggcctcccaaagtgctgggattacaggagtgagccaccatgtttggccccatgtgacacttagtttctaaaaatatgtatattcgtcctaaatccaaatttctaagataaaagcattcccaagatgtattcagagtccccgagtctactmctccaagggtggcatgccttaagacatccagctctgtgggggaagaggagcctgagtgttggggcggggaagcagggaacagtgagaagcgctgtgatgtctgagacgtgaagtcttgtgggaaaggggcaggccgtggagggcccgggaggcactcacaatgctccgaagcatcttgtccccaccactgaaggtgactgccagcatggaggcacattcttctgcatagaaaggcatgcgtccctcctcatccacagctcctagggacagaggagggagattagagctgagatgcagagg

SEQ ID NO: 9224 - DNA, 601 bp, Human
agaaattagcaaaagcccaaattttaccaaaggaagacactgcaaagaagttgtttgtgcatttccttgagtgtgaaaaagttgtttaatccatgtgacacttagtttcttttttttttttgagaaggagtcttgttctgtcacccaggctggagtacagtggtgcaatcttggctcactgtaacctccgcctccttgtttcaagcgattctcctgcctcagcctcccaagtagctgggattacagatgcccgccaccacaccaggctaatttttgtatttttagtagagacagggtttcrccatgttggccaggctggtcttgaactcctgacctcaagtgatccatccgccttggcctcccaaagtgctgggattacaggagtgagccaccatgtttggccccatgtgacacttagtttctaaaaatatgtatattcgtcctaaatccaaatttctaagataaaagcattcccaagatgtattcagagtccccgagtctactactccaagggtggcatgccttaagacatccagctctgtgggggaagaggagcctgagtgttggggcggggaagcagggaacagtgagaagcgctgtg

SEQ ID NO: 9225 - DNA, 601 bp, Human
gctccagagaaagagctctctctggtgttgacatgagacattcccccactcctcttcccactcatcccataaaaacgacaaccagactagctttcctcctgaagatgcacatgaccagaactcacagtatttacctaagagctgaagggcaatggaattaggagttttttttaagtccacagaaattagcaaaagcccaaattttaccaaaggaagacactgcaaagaagttgtttgtgcatttccttgagtgtgaaaaagttgtttaatccatgtgacacttagtttcttttttttttttgagaaggagtcttgttctgtcacccaggctggagtacagtggtgcaatcttggctcactgtaacctccgcctccttgtttcaagcgattctcctgcctcagcctcccaagtagctgggattacagatgcccgccaccacaccaggctaatttttgtatttttagtagagacagggtttcaccatgttggccaggctggtcttgaactcctgacctcaagtgatccatccgccttggcctcccaaagtgctgggattacaggagtgagccaccatgtttggccccatgtgacacttagttt

SEQ ID NO: 9226 - DNA, 601 bp, Human
gcacacagcccagcctctcttccctctctactttagtccactcccttttctcttctccctggggctgggaggagggggtagtaggggtcaactggcacagagccttggaacattgtgttgaccagaagtcatttattggcataacaaaattttagttttggaaaataaatttgacccagcaggaagacaaagcagcctaattcccaatggccccagagagatctcccgactcagccactggagaaatttgataccacctggctccagcccagctcctgcctagagcctcctatgcccacaytatatggttgcgggcaacagggacaggcagggagctctaggaagatggtctagaggcctgccttaaacctgctgggatggcgctaagcccagctgggtgtaggcgatcgtcttcaaattctttaaatgggttccacaggttagagaagctccatgaccctgctcgaatttcatttgctatggctccaattatagctccagagaaagagctctctctggtgttgacatgagacattcccccactcctcttcccactcatcccataaaaacgacaaccagactagctttcctcctgaagatg

SEQ ID NO: 9227 - DNA, 601 bp, Human
ggagccaaatggtgggaagcatatgcccccagcctctgccctcagaaagacagctctacccagctgccctggtcattgactagaaactggcaacaagaagtttccatagcaaggacattccaaagatgggaactctgctaaacacactctctcttcatttctgggcaaattacagttcagatggaagagggtggtgagggtgagaagctgaggtgagttaaaatgagaaaggccaggtacagcagagcaagagtgacaattatgttgtagaaccttcttaggtccctggcctgggcagggtgagctgggttccctagagttctgctagagggtggagtttggtatgttcctgttcttcctcctaacccagcctggcctgcagtgggtgccctctgtgcacacagcccagcctctcttccctctctactttagtccactcccttttctcttctccctggggctgggaggagggggtagtaggggtcaactggcacagagccttggaacattgtgttgaccagaagtcatttattggcataacaaaattttagttttggaaaataaatttgacccagcaggaagacaaagcagcctaattccc

SEQ ID NO: 9228 - DNA, 601 bp, Human
ggtttcccaactcttttcttttttcttatttttccttgtcgcctaggctggagtgcagtggtaagatcatagctcaccacagcctcgaactcctgggttccagcgatcctcctgcttcagcttcccatgtagctgggactacaggcgtgtaccactgcaccacactaatattcttattttttgtagagacagcatctcactatgttgcccaggctggtctcgaactcttggcctcaagcaatcttcctgccttggcctcccaaagtgtcgggattaacaggcatgagccaccatgggggggcctcccgatttttgctcctaatattcttgctcccattcctaaattctctatcccaactcccaactccaaacccttcaacccccacaaccaagctagacagaggaagtggccaggggagctactgggcccagctggagctgggacaacactgacggcactattcaaggaaatccaatttggcagctccgcgacaggggctggaatgatgtcggcgtgaacacagggagtgtgttccagcaagagaggactgtgtccttgcccacccccgagccctgcatggactcagtgtctataaggccc

SEQ ID NO: 9229 - DNA, 601 bp, Human
taggaaagggctcccatccagtgcagataagggtttcccaactcttttcttttttcttatttttccttgtcgcctaggctggagtgcagtggtaagatcatagctcaccacagcctcgaactcctgggttccagcgatcctcctgcttcagcttcccatgtagctgggactacaggcgtgtaccactgcaccacactaatattcttattttttgtagagacagcatctcactatgttgcccaggctggtctcgaactcttggcctcaagcaatcttcctgccttggcctcccaaagtgtcrggattaacaggcatgagccaccatgggggggcctcccgatttttgctcctaatattcttgctcccattcctaaattctctatcccaactcccaactccaaacccttcaacccccacaaccaagctagacagaggaagtggccaggggagctactgggcccagctggagctgggacaacactgacggcactattcaaggaaatccaatttggcagctccgcgacaggggctggaatgatgtcggcgtgaacacagggagtgtgttccagcaagagaggactgtgtccttgcccacccccga

SEQ ID NO: 9230 - DNA, 601 bp, Human
tgccctttccaagataacattccttttatgggaaatgcagtgactggcccaggggtttcattccacattgagggaaattgggcaagtgctggatgtggttaggaggagaaaactcaattcttctctgtgaaaccttcacctgagggaagccacccctcatcctcccttctgagtaaccttctctggccattccttctcctgccatggctctcaattgatcactttctaggaggacagaaaaagtgaagacagttttggtttgggcactaagcatagcatacttcctttgcaaaaagtagtraatgactccaggaaaaagaatcccccaaggagctgggggtagggaaaacgctggtaaatgtgcagacagggcatcctctgcacaagcatcctgatccagctgcactctcctctagggagggcgtccgcctcttcgctcaacataaaaccaggtcgctggcttagaggatacaaccccttcagacaatcctggttcatgctggccaccatggaggcggaggcagaggatgggtcactaaagcctaggagacttctacaaaccctctgtccatccccagcagaccacatctgactctctcta

SEQ ID NO: 9231 - DNA, 601 bp, Human
aagacacgcaagtgcaaagccaggggcttccaaatgaactgcattcctggaaatgtttctgaacttctctgacttggctgacgctttatgccctttccaagataacattccttttatgggaaatgcagtgactggcccaggggtttcattccacattgagggaaattgggcaagtgctggatgtggttaggaggagaaaactcaattcttctctgtgaaaccttcacctgagggaagccacccctcatcctcccttctgagtaaccttctctggccattccttctcctgccatggctctcrattgatcactttctaggaggacagaaaaagtgaagacagttttggtttgggcactaagcatagcatacttcctttgcaaaaagtagtaaatgactccaggaaaaagaatcccccaaggagctgggggtagggaaaacgctggtaaatgtgcagacagggcatcctctgcacaagcatcctgatccagctgcactctcctctagggagggcgtccgcctcttcgctcaacataaaaccaggtcgctggcttagaggatacaaccccttcagacaatcctggttcatgctggccaccatgga

SEQ ID NO: 9232 - DNA, 601 bp, Human
gactatttgcccataatcttatggaagctatgctctagtttctatcctttccactggtgaaggatcagaataagagatttaggtcgaggactcatttgtggagaggtggtagctaaggtcataaacatagctgtactgtcaaggaggatgatgtagagtgaggaaaaagtcaggaaacaagccttagaagacactcacagttcaggagtatgaaacaagtacctcaggcagagaaggcagaggagggctatggagccaagaaggccgccacagaagctacaggaggagagacgttgcaacmaagacctcattaatagggtcagagtgacaagaatgttaaaaaggatgaactctgaaccagcccctgaaccggtcaggaaaggggcactatgagtaagaaagcaagtcttctgtggcagagggagtgtgtgacaaaggggagaaattgcttcagttcattcatttgaaaagttgcctggttggaggtagcagggacttgcatttgaaggcagaaaggaagaatcagcagagagggaaatgttggttaaagagggaagacctggagaggagaaggaacaggactcactgcgtaggcagaggc

SEQ ID NO: 9233 - DNA, 601 bp, Human
cgccaccatgcccagctgatttttttgtatttttagtagagacggggtttcaccatgttggccaggatggtctcgatctcctgacctcgtgatctgcccacctcggcctcccaaagtgctgtgattacaggcgtgagccaccgtgcctggactatttgcccataatcttatggaagctatgctctagtttctatcctttccactggtgaaggatcagaataagagatttaggtcgaggactcatttgtggagaggtggtagctaaggtcataaacatagctgtactgtcaaggaggatgaygtagagtgaggaaaaagtcaggaaacaagccttagaagacactcacagttcaggagtatgaaacaagtacctcaggcagagaaggcagaggagggctatggagccaagaaggccgccacagaagctacaggaggagagacgttgcaacaaagacctcattaatagggtcagagtgacaagaatgttaaaaaggatgaactctgaaccagcccctgaaccggtcaggaaaggggcactatgagtaagaaagcaagtcttctgtggcagagggagtgtgtgacaaaggggagaaattgcttc

SEQ ID NO: 9234 - DNA, 601 bp, Human
acacagtgatttaggaacagaaagatgatggaaaatatttatggcatagttagaggacagcattgatgtggcagagaaggggcttacaggagagaaatgacgttatggaacagaatagaatcccaaaaggaaaagaatcccaaaaggagtgcttgtctgcgttcgcagtgtacgcagtggcatgctacatccatttacttcttggtgtggatgcggacttgggtggcagtgcaaatgagtacactagaactctctctaccagaactaaatgagttaatgcattaaatgagctaacgctgcraacagtgattggcacataaaaagcatcttattatgtggcctttggtaaattggaattttttcaacagtcactctctgtcccagaagacgccagggttctatttgcccataatctttttcttttcttttctttttcttttttttttttttttttttagacggagtcttgctcggtcaccaggctgcagtgcagtggcatgatctctgctcactgcaacctccacctcccaggttcaagcaattctcctgcctcagcctcccgagtagctgggactacaggagcccgccaccatgcccagct

SEQ ID NO: 9235 - DNA, 601 bp, Human
caagtttgggggcctagggaacggtgacggcactgacacgaatgggaaaatcttagaaagcaagccagcttttgagaggtgatagtgaaatctaaaattttgtacatgttaagtgtactgtattggtggaatatcaacagcacacagtgatttaggaacagaaagatgatggaaaatatttatggcatagttagaggacagcattgatgtggcagagaaggggcttacaggagagaaatgacgttatggaacagaatagaatcccaaaaggaaaagaatcccaaaaggagtgcttgtctgygttcgcagtgtacgcagtggcatgctacatccatttacttcttggtgtggatgcggacttgggtggcagtgcaaatgagtacactagaactctctctaccagaactaaatgagttaatgcattaaatgagctaacgctgcgaacagtgattggcacataaaaagcatcttattatgtggcctttggtaaattggaattttttcaacagtcactctctgtcccagaagacgccagggttctatttgcccataatctttttcttttcttttctttttcttttttttttttttttttttagac

SEQ ID NO: 9236 - DNA, 601 bp, Human
gtgctctcaaagcacctgtgttgtccctgttgcagtgcctataacactgcactatgcctataaacctcactgtcttccctaccaggttgtaagctcgttgaaggcaggaatagtgtcttatccccgagtctctagaactaatacagtgcctgggatgaagtaggcctcgaatatttgtagaatgaataagtcgattgagagatatttcacagaaaacaacaaaaagattaaattgcaagggaaagggctggggaagacctgggaagaggcgagggatattagagggatgaaacactcgcgygtttcaagtttgggggcctagggaacggtgacggcactgacacgaatgggaaaatcttagaaagcaagccagcttttgagaggtgatagtgaaatctaaaattttgtacatgttaagtgtactgtattggtggaatatcaacagcacacagtgatttaggaacagaaagatgatggaaaatatttatggcatagttagaggacagcattgatgtggcagagaaggggcttacaggagagaaatgacgttatggaacagaatagaatcccaaaaggaaaagaatcccaaaaggagtgcttg

SEQ ID NO: 9237 - DNA, 601 bp, Human
gatgactgagcaaggacaggggtgtttgtttgtttgagacggagtctagctctgtcacccaggctggagtgcagcggctagatgcttggctcactgccacctctacctcctgggttcaagcaattctcctgcctcagcctcccaagtagctgggattacaggcgcatgccaccacgcccagctaatttttgtagttttagtagagacggggtttcaccgtgttggccaggctggtctcgaactcctgacctcaggtgatccacctgcctgccttggcctcccaaagtgctgggattacagrcacgagccaccacacccagcctcattttctataattccatctgtcacctcttcaaagccaatgtcccatttctttgaaaacaacctctctccttccactttccccactctcttcttgaccccctcattttcccacaacccctcaagctcctttctcctaactggctgagattccatggctcatccaacatgtgtgtttacattctcaagctcccttcactttcttgtcctttcacagcaatacttggcaaaagtcaaacaatggctcagcctgattatccatcttcttggctagaccttt

SEQ ID NO: 9238 - DNA, 601 bp, Human
tgcaaggcagagtacaataccttgattttacagacacagtagctcagagaggcactgaaagtaggggctgggtaacctagggtgggatgcgctttaaagatttttgttttaaataagcaactaagagctattatagatgactgagcaaggacaggggtgtttgtttgtttgagacggagtctagctctgtcacccaggctggagtgcagcggctagatgcttggctcactgccacctctacctcctgggttcaagcaattctcctgcctcagcctcccaagtagctgggattacaggcgcrtgccaccacgcccagctaatttttgtagttttagtagagacggggtttcaccgtgttggccaggctggtctcgaactcctgacctcaggtgatccacctgcctgccttggcctcccaaagtgctgggattacaggcacgagccaccacacccagcctcattttctataattccatctgtcacctcttcaaagccaatgtcccatttctttgaaaacaacctctctccttccactttccccactctcttcttgaccccctcattttcccacaacccctcaagctcctttctcctaactggc

SEQ ID NO: 9239 - DNA, 601 bp, Human; identical to SEQ ID NO: 2392

SEQ ID NO: 9240 - DNA, 601 bp, Human; identical to SEQ ID NO: 2393

SEQ ID NO: 9241 - DNA, 601 bp, Human; identical to SEQ ID NO: 2394

SEQ ID NO: 9242 - DNA, 601 bp, Human; identical to SEQ ID NO: 2889

SEQ ID NO: 9243 - DNA, 601 bp, Human; identical to SEQ ID NO: 2890

SEQ ID NO: 9244 - DNA, 601 bp, Human; identical to SEQ ID NO: 2891

SEQ ID NO: 9245 - DNA, 601 bp, Human; identical to SEQ ID NO: 2892

SEQ ID NO: 9246 - DNA, 601 bp, Human; identical to SEQ ID NO: 2893

SEQ ID NO: 9247 - DNA, 601 bp, Human; identical to SEQ ID NO: 2894

SEQ ID NO: 9248 - DNA, 601 bp, Human; identical to SEQ ID NO: 2895

SEQ ID NO: 9249 - DNA, 601 bp, Human; identical to SEQ ID NO: 2896

SEQ ID NO: 9250 - DNA, 601 bp, Human; identical to SEQ ID NO: 2897

SEQ ID NO: 9251 - DNA, 601 bp, Human; identical to SEQ ID NO: 2898

SEQ ID NO: 9252 - DNA, 601 bp, Human; identical to SEQ ID NO: 2899

SEQ ID NO: 9253 - DNA, 601 bp, Human; identical to SEQ ID NO: 2900

SEQ ID NO: 9254 - DNA, 601 bp, Human; identical to SEQ ID NO: 2901

SEQ ID NO: 9255 - DNA, 601 bp, Human; identical to SEQ ID NO: 2902

SEQ ID NO: 9256 - DNA, 601 bp, Human; identical to SEQ ID NO: 2903

SEQ ID NO: 9257 - DNA, 601 bp, Human; identical to SEQ ID NO: 2904

SEQ ID NO: 9258 - DNA, 601 bp, Human; identical to SEQ ID NO: 2905

SEQ ID NO: 9259 - DNA, 601 bp, Human; identical to SEQ ID NO: 2906

SEQ ID NO: 9260 - DNA, 601 bp, Human; identical to SEQ ID NO: 2907

SEQ ID NO: 9261 - DNA, 601 bp, Human; identical to SEQ ID NO: 2908

SEQ ID NO: 9262 - DNA, 601 bp, Human; identical to SEQ ID NO: 2909

SEQ ID NO: 9263 - DNA, 601 bp, Human; identical to SEQ ID NO: 2910

SEQ ID NO: 9264 - DNA, 601 bp, Human; identical to SEQ ID NO: 2911

SEQ ID NO: 9265 - DNA, 601 bp, Human; identical to SEQ ID NO: 2912

SEQ ID NO: 9266 - DNA, 601 bp, Human; identical to SEQ ID NO: 2913

SEQ ID NO: 9267 - DNA, 601 bp, Human; identical to SEQ ID NO: 2914

SEQ ID NO: 9268 - DNA, 601 bp, Human; identical to SEQ ID NO: 2915

SEQ ID NO: 9269 - DNA, 601 bp, Human; identical to SEQ ID NO: 2916

SEQ ID NO: 9270 - DNA, 601 bp, Human; identical to SEQ ID NO: 2917

SEQ ID NO: 9271 - DNA, 601 bp, Human; identical to SEQ ID NO: 2918

SEQ ID NO: 9272 - DNA, 601 bp, Human; identical to SEQ ID NO: 2919

SEQ ID NO: 9273 - DNA, 601 bp, Human; identical to SEQ ID NO: 3379

SEQ ID NO: 9274 - DNA, 601 bp, Human; identical to SEQ ID NO: 3380

SEQ ID NO: 9275 - DNA, 601 bp, Human; identical to SEQ ID NO: 3381

SEQ ID NO: 9276 - DNA, 601 bp, Human; identical to SEQ ID NO: 3382

SEQ ID NO: 9277 - DNA, 601 bp, Human; identical to SEQ ID NO: 3383

SEQ ID NO: 9278 - DNA, 601 bp, Human; identical to SEQ ID NO: 3384

SEQ ID NO: 9279 - DNA, 601 bp, Human; identical to SEQ ID NO: 3385

SEQ ID NO: 9280 - DNA, 601 bp, Human; identical to SEQ ID NO: 3386

SEQ ID NO: 9281 - DNA, 601 bp, Human; identical to SEQ ID NO: 3387

SEQ ID NO: 9282 - DNA, 601 bp, Human; identical to SEQ ID NO: 3388

SEQ ID NO: 9283 - DNA, 601 bp, Human; identical to SEQ ID NO: 3389

SEQ ID NO: 9284 - DNA, 601 bp, Human; identical to SEQ ID NO: 3390

SEQ ID NO: 9285 - DNA, 601 bp, Human; identical to SEQ ID NO: 3391

SEQ ID NO: 9286 - DNA, 601 bp, Human; identical to SEQ ID NO: 3392

SEQ ID NO: 9287 - DNA, 601 bp, Human; identical to SEQ ID NO: 3393

SEQ ID NO: 9288 - DNA, 601 bp, Human; identical to SEQ ID NO: 3394

SEQ ID NO: 9289 - DNA, 601 bp, Human; identical to SEQ ID NO: 3395

SEQ ID NO: 9290 - DNA, 601 bp, Human; identical to SEQ ID NO: 2212

SEQ ID NO: 9291 - DNA, 601 bp, Human; identical to SEQ ID NO: 2213

SEQ ID NO: 9292 - DNA, 601 bp, Human; identical to SEQ ID NO: 2214

SEQ ID NO: 9293 - DNA, 601 bp, Human; identical to SEQ ID NO: 2215

SEQ ID NO: 9294 - DNA, 601 bp, Human; identical to SEQ ID NO: 2216

SEQ ID NO: 9295 - DNA, 601 bp, Human; identical to SEQ ID NO: 2217

SEQ ID NO: 9296 - DNA, 601 bp, Human; identical to SEQ ID NO: 2218

SEQ ID NO: 9297 - DNA, 601 bp, Human; identical to SEQ ID NO: 2219

SEQ ID NO: 9298 - DNA, 601 bp, Human; identical to SEQ ID NO: 2220

SEQ ID NO: 9299 - DNA, 601 bp, Human; identical to SEQ ID NO: 2221

SEQ ID NO: 9300 - DNA, 601 bp, Human; identical to SEQ ID NO: 2222

SEQ ID NO: 9301 - DNA, 601 bp, Human; identical to SEQ ID NO: 2223

SEQ ID NO: 9302 - DNA, 601 bp, Human; identical to SEQ ID NO: 2224

SEQ ID NO: 9303 - DNA, 601 bp, Human; identical to SEQ ID NO: 2225

SEQ ID NO: 9304 - DNA, 601 bp, Human; identical to SEQ ID NO: 2226

SEQ ID NO: 9305 - DNA, 601 bp, Human; identical to SEQ ID NO: 2227

SEQ ID NO: 9306 - DNA, 601 bp, Human; identical to SEQ ID NO: 1683

SEQ ID NO: 9307 - DNA, 601 bp, Human; identical to SEQ ID NO: 1684

SEQ ID NO: 9308 - DNA, 601 bp, Human; identical to SEQ ID NO: 1685

SEQ ID NO: 9309 - DNA, 601 bp, Human; identical to SEQ ID NO: 1686

SEQ ID NO: 9310 - DNA, 601 bp, Human; identical to SEQ ID NO: 1687

SEQ ID NO: 9311 - DNA, 601 bp, Human; identical to SEQ ID NO: 1688

SEQ ID NO: 9312 - DNA, 601 bp, Human; identical to SEQ ID NO: 1689

SEQ ID NO: 9313 - DNA, 601 bp, Human; identical to SEQ ID NO: 1690

SEQ ID NO: 9314 - DNA, 601 bp, Human; identical to SEQ ID NO: 1691

SEQ ID NO: 9315 - DNA, 601 bp, Human; identical to SEQ ID NO: 1692

SEQ ID NO: 9316 - DNA, 601 bp, Human; identical to SEQ ID NO: 1693

SEQ ID NO: 9317 - DNA, 601 bp, Human; identical to SEQ ID NO: 1694

SEQ ID NO: 9318 - DNA, 601 bp, Human; identical to SEQ ID NO: 1695

SEQ ID NO: 9319 - DNA, 601 bp, Human; identical to SEQ ID NO: 1696

SEQ ID NO: 9320 - DNA, 601 bp, Human; identical to SEQ ID NO: 2304

SEQ ID NO: 9321 - DNA, 601 bp, Human; identical to SEQ ID NO: 2305

SEQ ID NO: 9322 - DNA, 601 bp, Human; identical to SEQ ID NO: 2306

SEQ ID NO: 9323 - DNA, 601 bp, Human; identical to SEQ ID NO: 2307

SEQ ID NO: 9324 - DNA, 601 bp, Human; identical to SEQ ID NO: 2308

SEQ ID NO: 9325 - DNA, 601 bp, Human; identical to SEQ ID NO: 2309

SEQ ID NO: 9326 - DNA, 601 bp, Human; identical to SEQ ID NO: 2310

SEQ ID NO: 9327 - DNA, 601 bp, Human; identical to SEQ ID NO: 2311

SEQ ID NO: 9328 - DNA, 601 bp, Human; identical to SEQ ID NO: 2312

SEQ ID NO: 9329 - DNA, 601 bp, Human; identical to SEQ ID NO: 2313

SEQ ID NO: 9330 - DNA, 601 bp, Human; identical to SEQ ID NO: 2314

SEQ ID NO: 9331 - DNA, 601 bp, Human; identical to SEQ ID NO: 2315

SEQ ID NO: 9332 - DNA, 601 bp, Human; identical to SEQ ID NO: 2316

SEQ ID NO: 9333 - DNA, 601 bp, Human; identical to SEQ ID NO: 2317

SEQ ID NO: 9334 - DNA, 601 bp, Human; identical to SEQ ID NO: 2318

SEQ ID NO: 9335 - DNA, 601 bp, Human; identical to SEQ ID NO: 2319

SEQ ID NO: 9336 - DNA, 601 bp, Human; identical to SEQ ID NO: 2283

SEQ ID NO: 9337 - DNA, 601 bp, Human; identical to SEQ ID NO: 2284

SEQ ID NO: 9338 - DNA, 601 bp, Human; identical to SEQ ID NO: 2285

SEQ ID NO: 9339 - DNA, 601 bp, Human; identical to SEQ ID NO: 2286

SEQ ID NO: 9340 - DNA, 601 bp, Human; identical to SEQ ID NO: 2287

SEQ ID NO: 9341 - DNA, 601 bp, Human; identical to SEQ ID NO: 2288

SEQ ID NO: 9342 - DNA, 601 bp, Human; identical to SEQ ID NO: 2289

SEQ ID NO: 9343 - DNA, 601 bp, Human; identical to SEQ ID NO: 1602

SEQ ID NO: 9344 - DNA, 601 bp, Human; identical to SEQ ID NO: 1603

SEQ ID NO: 9345 - DNA, 601 bp, Human; identical to SEQ ID NO: 1604

SEQ ID NO: 9346 - DNA, 601 bp, Human; identical to SEQ ID NO: 1605

SEQ ID NO: 9347 - DNA, 601 bp, Human; identical to SEQ ID NO: 1606

SEQ ID NO: 9348 - DNA, 601 bp, Human; identical to SEQ ID NO: 1607

SEQ ID NO: 9349 - DNA, 601 bp, Human; identical to SEQ ID NO: 1608

SEQ ID NO: 9350 - DNA, 601 bp, Human; identical to SEQ ID NO: 1609

SEQ ID NO: 9351 - DNA, 601 bp, Human; identical to SEQ ID NO: 2956

SEQ ID NO: 9352 - DNA, 601 bp, Human; identical to SEQ ID NO: 2957

SEQ ID NO: 9353 - DNA, 601 bp, Human; identical to SEQ ID NO: 2958

SEQ ID NO: 9354 - DNA, 601 bp, Human; identical to SEQ ID NO: 2959

SEQ ID NO: 9355 - DNA, 601 bp, Human; identical to SEQ ID NO: 2960

SEQ ID NO: 9356 - DNA, 601 bp, Human; identical to SEQ ID NO: 2961

SEQ ID NO: 9357 - DNA, 601 bp, Human; identical to SEQ ID NO: 2962

SEQ ID NO: 9358 - DNA, 601 bp, Human; identical to SEQ ID NO: 2963

SEQ ID NO: 9359 - DNA, 601 bp, Human; identical to SEQ ID NO: 2964

SEQ ID NO: 9360 - DNA, 601 bp, Human; identical to SEQ ID NO: 2965

SEQ ID NO: 9361 - DNA, 601 bp, Human; identical to SEQ ID NO: 2966

SEQ ID NO: 9362 - DNA, 601 bp, Human
gccttattggacccaggagtcctgcaccccacctccccagcttcccggggcttgagatcccttggagactgagcaggtcctgaggcctggcagcaggaccaggccaccactggacatctgctcaatggggccctgctgccggggtgacaagcatccctctaccagggctccagggttctgctggccaccactagccatccttcctcccagcaggggcagaggacacttccccaggggaacaggtcctcctggtgcccccccactccccgccccagccggaaacccggcagctgagcagttrgatagaagatttttcctcccacgccaccctgtcaggggtcggccagcagggccgggccacaggcttccttgtgagccaggcctggagcccctgggggcccacccggatgtggctaccccccggctggccagtggggagccggctgctgcccaggacatgtgtccccagggaggcctgggaggaaggaagtctatgccctcctcacaggggctgactcacaggcgcccaatggggggccccagctgggagactgggaatgtgatcaatcagggaggtggacacacaaggggacctctgaca

SEQ ID NO: 9363 - DNA, 601 bp, Human
acttttatattctctcctctgggactcactcattcatccaataagcattcattgggaagtgagcccttcttgtgtgcatttaggcactgatcagacattttgggggtcccttctgtgtgggggtctctataatcactagctatggggccgctctgtttcagcttccccatctgtaaaatggaagtaatcgttggacctacctcctagggctgttaggaaccttggaagaggtaatattttgtaaaagtagttagaaaaatgcctgatatgatcttggcatggtgccatgagcctgtagttrcagctactctggaggctgaggcaggaggatctcttgagcccaggagttcgaggcagcagtgagctatgattgtgccactgcactccagcctggaagacagagtgagaccctgtctctaaaaagagaaagaaaaatgtctgatgtgtagcagacgctcagtaaatgccattgttcttatgggaggactggtggaaggggcccaatgaggggggttcccagccgttgcctgggcagtgagggacctggagtgggcgcagctgttttgaggaaggctcctgccagggtttggccctgcagttg

SEQ ID NO: 9364 - DNA, 601 bp, Human
aaacattgtcgactctgcatggcccccttccatcgagggcagaggcacctacttgtgctttttggggtttcttgtggagatcggctgtgggggttccaccatggcctcatgtgacaggggcaccctttgttgccactgccctgcagacatgcccagcgggacatggccacatgcagagacggtgcctgtggaggggtgtgtggcagagagaaccccatttgtaggttcgcatctccaccttgcattccctttcatgggttccttacaaggtggatgccatgctgccacctggttggcagawgaggaaatccaggttcagagaggttgagtcaggcatcaggagccacacagccaatacgtgtccccctttgtaatgtgagccctgggagagcagtgttcgtctgtgctgttcaccgtggtatctcagggcctagcctggtgtctggcacacagtaggccctcagtaacacctgaagagaggatgaaggagggcgtgattggaggcagcaaatgtacccaggcccctgtggctctgtagcttgtgttgtgcagccactacccctgcccagggagggagtcactggagtggcactgctgttca

SEQ ID NO: 9365 - DNA, 601 bp, Human
ccaagtagttaggactacaggtgcacgtgctgcaatgccaactcatttttgtgttggtttttttggagagatgggctttcaccatgttgcccaggctggtctcaaactcctgggctcaagtgatcctcctgcctcagcctcccaaagtgctgggattacaggcctgagcctccgacctcagcctttatatagggccttcagtgtgttgaggtacaacataccatctatgcttaatttgttgaaaatttttatcataaagatatgttgaattttgtcaaatactctctctgcatctatcgaratgatcatatggtttttgtacttcaaaagcaggattccagagtctagaatcaattctgccaaattggccatgccccttacagaatgccacttggtaggggagtgcatgtttccctgcatcttcaccagcactgggtgttatggtcgcgttggatttctgctgtggtgcccggtgtgtaatggggcctacacctgcttgcccacctgcttactccttgtcgcccccccacccacgtgtctttcagcccggccgcaccacctgggtctccgccatgaacgggcctgccctgcagccctcctc

SEQ ID NO: 9366 - DNA, 601 bp, Human
cgggacccccggagaggctgctgagacccccgcccggcctggcctggccaagaagttcctgccctggagcctggcccgggagccgccacccgaggcgctgaaggaggcggtgctgcgctacagcctggccgacgaggcctccatggacagcggggcacgctggcagcgcgggaggctggcgctgcgccgggccccgggccccgatggccccgaccgcgtgctggagctcttcgacccacccaaggtaagtaagccctgcccgcggggttgcgcactgcactgcgcccttcgccttcacccwggggagagcgcgggctggggaggtgtgatggctttccagctggtggccacagagtgtccagagggaactaggccctcttaaaaaagaacttttaggccgagtgcaatggcttatgcctgtaatcccagcactttgggaggccgaggcaggaggatcgcttgagcccaggacttcgagaccagcttgggcaacttagcgagaccctatctctataaaaaattagccaggtgtggtggtacgtgcctgtggtcccagctgttcgggagactgagaagggaggatgacttgagcccaggaggt

SEQ ID NO: 9367 - DNA, 601 bp, Human
aatgtccagggacacctttttgccttcacatttgggtgtcatgtgggctggtagcaggtcactctgagatccttgaaaactctgactcagactggcattgacagattggtgttttatttccagagggctcaaaaccttcagagaatttctctgcacctcctgtgccttggtgatattttgcaagttaaaaagaatttgtcctttggcaaaaccccattgctacaaaaaataccaaaattagctgggcgtggtggtgtacgcctgtggtcccagctactctggaggctatggtgggaagatygcttgagcccagaagaccaaggctgcagtaagccaagatcgcaccacagcactacagcctgggtgacagagcgagaccctgtctcaaaaaaaaaaaaaaaaaaaaaaaagttcttttccttcacagctggcttaattcctactgtgctgttgaggctgaaaggtcactgtgttctactcacctgccaggctccatctttgactcaggtatgcatgacaggaccatatggctttcatctaattgctctctctttgggatcctgttacgtggtagggccttactctagagcatgagcaaaac

SEQ ID NO: 9368 - DNA, 601 bp, Human
tcagactggcattgacagattggtgttttatttccagagggctcaaaaccttcagagaatttctctgcacctcctgtgccttggtgatattttgcaagttaaaaagaatttgtcctttggcaaaaccccattgctacaaaaaataccaaaattagctgggcgtggtggtgtacgcctgtggtcccagctactctggaggctatggtgggaagatcgcttgagcccagaagaccaaggctgcagtaagccaagatcgcaccacagcactacagcctgggtgacagagcgagaccctgtctcaaaaaaaaaaaaaaaaaaaaaaaagttcttttccttcacagctggcttaattcctactgtgctgttgaggctgaaaggtcactgtgttctactcacctgccaggctccatctttgactcaggtatgcatgacaggaccatatggctttcatctaattgctctctctttgggatcctgttacgtggtagggccttactctagagcatgagcaaaaccgatgtgatactggccctgaggggctcacgatgtgggtggaggaaacctatggttactctttcattcattcgacagatatttatgg

SEQ ID NO: 9369 - DNA, 601 bp, Human
catcatgtgaatggaatcacacagtaggttgcctttgttttattttattattttattttgagacagggtctcactgtgtcacctaggctggagtgcagtggtgtgatcatggctcgctgtagcctcaacctcccagcctcaggttatttttgtgcctcagcctccccagtagctgggatcaccgtcacgtgccaccactcccagctaataaataggttgccttttatttctggctccttttgcccagcataatgttttagagattgatcacattgatcgtacatgtcaatagtgtcttccttttttttttttttttttttttttttgagacaaggtctcgctctgtcacccagctggagtgcagtggctcgatctcagcttactgcatcctctgcctcttgtcctcctgggctcaagcagtcctcccacctcagcctcccgagtaactgggaccacaggcacgtgccaccacacctggctaatttttgtattttttgtggagatgggatttcaccatgttgtcaaggctggtctcgaactcctgggctcaaatggtccccccacttcggcctcccaaagtgctatgattactggcatgagc

SEQ ID NO: 9370 - DNA, 601 bp, Human
gcctcggcctcccaaagtgctgggattacaggtgcgagccaccacgcctggccaggaggtcacttactttcattctaagtaaatcactgggccttccaggcagagggaacagcatgggcagagaccctgagtggggaatgtgtttagcatgttttgaagaaaggacaagatgaagaggccggtgtggtgggagcagagagagggagatggggagcggggaagtacatgtgggtggaggacactgggaacgggaggacttagtgttttattccaagcacaatcagaagctgttgggaaaacrcaagcacagataaaaaacggttttctcatcatttgttaaaaatctcaaggctgtgacaccatgaaagacaaataacggccccaatacatgatcttatctgtgtgacactgtagggtttttatttttttattttttatttttttgagacagagtcttgctctgttgcccaggctggagtgcagtggcacggtgtcagctcactgccagctccgcctcccgggttcatgccattctcctgcctcagcctcccgggtagctgggactacaggtgcccgccaccacacctggctaatttttttg

SEQ ID NO: 9371 - DNA, 601 bp, Human
cccaagactcctgttctctgggagccctgatggtagggccccatcagattccctagggcttttcccaatccagggaaccagggaggtcccagagggctttgccgtagccctggctggctggggctctgtcacaggcttggtggttgctgcggggcctggggtgttgcctgcaaagcaagcagccctggggaggcttctcctagcccctcggagcatcaggtggaacagtccgggcggctcaggagcatcccctcagtgaatctgtgtccaggtgatgggccaagggtgctcagaccacaaytcttgcatgtgcttgccaggtagtcaactgtgatccctgacctctgacccaggggttggctctgggaacagttttaaacaaaaggaaaagaaagttctgacaaccagtgggtggtggcgaagggcttaagctttggatctgcacttgcggtctgtcacttaaagggtgccctgcaggagagggagcagatgtaatcccagtgccagcctggtggaggccctgctgcccagggctggaagaggctttggagggagagagccaagagaaggcagctgcccagaagtctgaggccaggtgggc

SEQ ID NO: 9372 - DNA, 601 bp, Human
agaaggaggtgagagagactttgcttctgagggccccttctgagcccttctagtcttctttagttcaagtacgtagcatgccacagcacctttctttggggtgttgttttctgagccccaacattcatggccctgaatgtgtgcctctgtgtgccaggtgttgccctaaattcttggaccttcccatgagctggagttcactgacccatttgacagatgaggaaactgaggcactgggagaagcaaagagacttgcctgggatcatgaagtgaaggggatctgaaccctgagacaggaacycttgatcccaaggggcccctaaccccaagcccttggccccctgctgaactggttcaaaccagagagtgtataacccagctccaggctgggctgggcctgaggtgtgcgtctcacctggcagttacaagaaaaggaaattgcactggttgccacatttacaacctaaagtggagagatttcacagaatccagacttctggtttctcttatggaatccggggatcggccgggcacggtggctcatacctgtaatcccaggactttgggaggcgaaggcagatggatcacttgaagtcaggag

SEQ ID NO: 9373 - DNA, 601 bp, Human
agtgtataacccagctccaggctgggctgggcctgaggtgtgcgtctcacctggcagttacaagaaaaggaaattgcactggttgccacatttacaacctaaagtggagagatttcacagaatccagacttctggtttctcttatggaatccggggatcggccgggcacggtggctcatacctgtaatcccaggactttgggaggcgaaggcagatggatcacttgaagtcaggagttcaagagcagcctggccaacatagtgaaacccagtctctactaaaaatacaaaaattagctggscacagtgacgtgtgcctataatcccagctactcgggaggctgaggcaggagaatcacttgagcccaggaggtggaggttgcagtgagctgagattgcaccgttgcactccagcctgggcgacagagcaagactccatctcaggaaaaaaaaaaaaaaaaaaaaaaaaaaaaaatcagaggatctggcggtgccaggccggcattggagggggtcccagcctggcctgtgctgccactggttcagcagtagagcctgacggggaggcgacagcagtgggggccctggggaaggagaaagat

SEQ ID NO: 9374 - DNA, 601 bp, Human
ccaccccaaccccaagaggaactctcccagtcagatggtggaggcagttgcgtcatcaggaaaccatggccggttcgataagctcagtgctgagggagaggcacaggaattgcactaatcatgactcagtggtcagagaaggctccctggaggagaggaggttttctctgctgggacatgcagtttgggtcaggcagggcatcacaaatgcaggggctgggtggcaggggaaggtgtgggcgggaaggcggctggagggagaccaggtgttgggggtgctggggctgggggtgggcagatsaggattggagccctggctcaacttcgctattccccatggctggggcactgtgtgattttgcctcccagagtctgtagcatgggggctcctgatggtgcccttgcggggaggtcagggggctgacacacctgagcctgcctttcagcctgccctcttccctggccagctggaggggccttgggaggcccaccccagccctgagagcactggcttgtagcatccctatcactcatggtcttcactggggtgggggatggcagtaggggcaatcatcccctatgccccccgttacccagcaca

SEQ ID NO: 9375 - DNA, 601 bp, Human
ccatttctgtgacttcctcttggaaaactttttgaaaaatgttgccggcctgtgaattccacaatctggaaactgctggtgggccacccaggctccaatgcctggcacacagcagatgctcactaaagggtggtgtggggtctgtgagcgtcatttccagccacagtcaagcccctgttgtcttctagcctggggctgtgccttctgccctctgggtgttggctcttgctattcccttaacctccagtgcctttttctccaccatccccacttcggagaatattcagcaaacgctactgcycctttctctgtgctgggccaagaccgaaagatggaaaaggaagagggaggccttcttgagcctctggtgcatgggagcaggggagtgacaactcaggagggctgcccagggaggggccttcttgctcccaagtctctcttaaggctgagctcctaaggccctgtgctcctccctgccttaccattcccctgagatccttccataccctctgggagctctgttgcacacactatgctcatattctcagggaagggtagtggcattattatcccaccttagaaaatgcagactcttgcttga

SEQ ID NO: 9376 - DNA, 601 bp, Human
ctcaggtaggcgggagtcagggagagctgcgtgaccccacgaggctggtgtttcatcttcacttctcagatgacgggactgtggctcagagacctttgcagggggactgatcacagcacagggccatttgaagggagcctggaactgcatttccatgtggaccctgggtggatctggaaccaggctggctttcctagctcccccgccctttggctcccttatgttcttagccttcttttcacaacaaactcagaagcagccaagtagttggttgtgttgtctacagttgcactgaagcackttttatttcggctaagtgacagtcctttgttgtccctgtcttgtaattagttagggtagtatgttggttatattacgtggaatttattgcaggatggtaagggagcatgtgacaaaatggggcaatagttctgtaaggctgagagaagctgggggtgtacccagtggctaggctactcagaggggactgtcatgctgtcagtagtgtagtgggagccaagcaggctttactcaccggcctgttaacagctgtgcgagtcatgcctttcgcttgtgttagctcaccttgtgaaaaaatgag

SEQ ID NO: 9377 - DNA, 601 bp, Human
tgtgaaaaaatgagctgaattacagatgacaactaaggcatggagagccgaaccctttgtccagggttgtataggaagtggcagggtcagggctgaatcttaaaacctagagggtagggcccggcgtggtggctcatgcctaaaatcccagcactttgggaggccaaggcaggcggatcacctgatgtcagaagttcgagaccaacctggccaaccaacatggtgaaaccccagctctactaaaaatacaaaaattagctgggtgtggtggcaggtgcctgtaatcccagctactgcggargctgaggcaggagaatcgcttgaactcaggaggtggaggttgcagtgagccgagattgcgccactgcactccagcatgggcaacagagtgagaatctgtctcaaaaaacaaaaacaaaaacaaaaaaccctagaggataaaagaactataacatctgggataaagttagctgttgaaataaatacaagtcctaccgttggggtagtgtcagagctggcctacgtctttgactttgagattcctagcagccagagcaaagaaagaaatagattattcccactggagccacagtggccataa

SEQ ID NO: 9378 - DNA, 601 bp, Human
gctggacctctgggagtaggaggtgaaaatgccctggctggtgctggtcacttcaggctggaattttctagtcatgcagctttctagtgagaggccgcagtgagctgtggccagtgttggtcattcctgcagtcattactctcccccagcctgttgtgtccgccaaccagagcaggcccgggagctcccaggagacctgctggaagggcccaggtggccatcctgctcctgccaggctgccctcttacctcactgttcattgactctcctgcaggtggggaagggggataaaggaggtggmcaggccactgggtcatgatccttccgacagaggtacctggcagctctgtgtgtaaagcaaggttaagcatctggttttgggggtcaattcaacagcactagcagctccagtccaaggtatgcccttttgggctgaggtggaggtcagatcacctgaagccacagttgctagaacatcctttgggctgcctctgctttccatccccctgctcccagtttgttaggggttgtagtattttccaggaacacctgaatggagggggcccagtggggccacttctgtccattccttatctcatct

SEQ ID NO: 9379 - DNA, 601 bp, Human
gggcccaggtggccatcctgctcctgccaggctgccctcttacctcactgttcattgactctcctgcaggtggggaagggggataaaggaggtggccaggccactgggtcatgatccttccgacagaggtacctggcagctctgtgtgtaaagcaaggttaagcatctggttttgggggtcaattcaacagcactagcagctccagtccaaggtatgcccttttgggctgaggtggaggtcagatcacctgaagccacagttgctagaacatcctttgggctgcctctgctttccatcccyctgctcccagtttgttaggggttgtagtattttccaggaacacctgaatggagggggcccagtggggccacttctgtccattccttatctcatctctttctccccttttcttctttcggccatcttttcagtcttatcacaagaggaaggggaggggcaaaccccctcctgagcagattcccaaccggaagcagctggctccttggctgcagagtgccccagcacaggaagcatctgcagggtcagttgagacctgggagcaggtttcctgctggcaaaggaacagtggctaactcctat

SEQ ID NO: 9380 - DNA, 601 bp, Human; identical to SEQ ID NO: 3314

SEQ ID NO: 9381 - DNA, 601 bp, Human; identical to SEQ ID NO: 3315

SEQ ID NO: 9382 - DNA, 601 bp, Human; identical to SEQ ID NO: 3112

SEQ ID NO: 9383 - DNA, 601 bp, Human; identical to SEQ ID NO: 3113

SEQ ID NO: 9384 - DNA, 601 bp, Human; identical to SEQ ID NO: 3114

SEQ ID NO: 9385 - DNA, 601 bp, Human; identical to SEQ ID NO: 3115

SEQ ID NO: 9386 - DNA, 601 bp, Human; identical to SEQ ID NO: 3116

SEQ ID NO: 9387 - DNA, 601 bp, Human; identical to SEQ ID NO: 3117

SEQ ID NO: 9388 - DNA, 601 bp, Human; identical to SEQ ID NO: 3118

SEQ ID NO: 9389 - DNA, 601 bp, Human; identical to SEQ ID NO: 3119

SEQ ID NO: 9390 - DNA, 601 bp, Human; identical to SEQ ID NO: 3120

SEQ ID NO: 9391 - DNA, 601 bp, Human; identical to SEQ ID NO: 3121

SEQ ID NO: 9392 - DNA, 601 bp, Human; identical to SEQ ID NO: 3122

SEQ ID NO: 9393 - DNA, 601 bp, Human; identical to SEQ ID NO: 3123

SEQ ID NO: 9394 - DNA, 601 bp, Human; identical to SEQ ID NO: 3124

SEQ ID NO: 9395 - DNA, 601 bp, Human; identical to SEQ ID NO: 3125

SEQ ID NO: 9396 - DNA, 601 bp, Human; identical to SEQ ID NO: 3126

SEQ ID NO: 9397 - DNA, 601 bp, Human; identical to SEQ ID NO: 3127

SEQ ID NO: 9398 - DNA, 601 bp, Human; identical to SEQ ID NO: 3128

SEQ ID NO: 9399 - DNA, 601 bp, Human; identical to SEQ ID NO: 3129

SEQ ID NO: 9400 - DNA, 601 bp, Human; identical to SEQ ID NO: 3130

SEQ ID NO: 9401 - DNA, 601 bp, Human; identical to SEQ ID NO: 3131

SEQ ID NO: 9402 - DNA, 601 bp, Human; identical to SEQ ID NO: 3132

SEQ ID NO: 9403 - DNA, 601 bp, Human; identical to SEQ ID NO: 3133

SEQ ID NO: 9404 - DNA, 601 bp, Human; identical to SEQ ID NO: 3134

SEQ ID NO: 9405 - DNA, 601 bp, Human; identical to SEQ ID NO: 3135

SEQ ID NO: 9406 - DNA, 601 bp, Human; identical to SEQ ID NO: 3136

SEQ ID NO: 9407 - DNA, 601 bp, Human; identical to SEQ ID NO: 3137

SEQ ID NO: 9408 - DNA, 601 bp, Human; identical to SEQ ID NO: 3138

SEQ ID NO: 9409 - DNA, 601 bp, Human
cttttttttttttttctttttgagacggagtctcagtctgttacccaagctggagtgcaatgctgcgatctcagctcactgcaacctccgcctcccaggttcaagcaattctcctgcctcagcctcccgagtaaggggaccataggcacccaccaccatgcccagctaatttttttgtatttttagtagagacggggtttcaccattttggcaaggctggtcttgaattcctgacctcaggtgatccacccgcccgcctcagcctcccaaagtgctgggattacaggtgtgagccactgtrcctggcctaggctccatattttcatattcattcagtacctgctgagtaccaggccctgtgctggcactgccataggacatgaaggtttgcccttgaacagtttatagtgttgtggtaagacacaccagcaccaccccgggataggtgtggcaacaggcacaatccagtgacagctgcaaccaccacccattaccagggacttaatattctccaagcaccagctatgcatatgctgttccaccctgacaacaccaggacaatcaccccttttttatgggtggagaaactgaggctcagaaa

SEQ ID NO: 9410 - DNA, 601 bp, Human
ccctgacaacaccaggacaatcaccccttttttatgggtggagaaactgaggctcagaaagttatgtattttgtcccaggttggtggctaatgctgaatttaaatccatgtcatgatatgtcaccactgggggaagctgactgatgggtacacaggatttctcttcactattttggcaacttcttatgagtccatagtttgaaaataagaagttaagggggaaaaaaggatttcagccctttctggtggctcacacctgtaattcagcacgttgggaggccgaagtccaagagttccagascagcataggcaacatagtgtgaccccccacgtttacaaaaaattaaaaagttagccggatgtgagattcatgcctgtagtcccagctactcgggaggctgaggcagagaatgacttgagcccaggaggttgaggctgcagtgagccatgatctcaccactgcactccagcctggacaacggagcaagaccttgtctcaaaaaagaaaaaaaaaagtatttcagaaagaaggacccatttgaaggccgggtgcagtggctcacgcctgtaatcccaacactttgggaggtcaagtagggcg

SEQ ID NO: 9411 - DNA, 601 bp, Human
tgcaaatacgtaaacctgccttctcctcgtcacagccctaaggaggtatgcgctactatttaatacttccattttactgagtaagtgacaggctcagagagataaagtgacttttcctagatcgcaccactaatagatgacagatacttggttttacctcatgactccaaatccgttgctttttcccagccctggaattgggtagggtttgggccggggacccctccccactcaagactcctgcaggaaaggtccgcccttcccccagggacttttcacctcacccaccatcagctgggcygtcatggaactttatggagcctgagctctcctccttcaggctgagtggccatgcccagccttcgtttccccggctgtaaagcagggccaacgggagctcagagctgtgtggggctccccagatgttggcggtgacatgcttggagaaatgccaggctccttagggtgttaggagagacctgtggccacagctgctgctccgactgggaccgggcaggcgctcccagggacaacagagggaggcagagggaagcccaggttcccaccctccattttgtaggctcctgcagcccgaacgcct

SEQ ID NO: 9412 - DNA, 601 bp, Human
ctcctgcaggaaaggtccgcccttcccccagggacttttcacctcacccaccatcagctgggctgtcatggaactttatggagcctgagctctcctccttcaggctgagtggccatgcccagccttcgtttccccggctgtaaagcagggccaacgggagctcagagctgtgtggggctccccagatgttggcggtgacatgcttggagaaatgccaggctccttagggtgttaggagagacctgtggccacagctgctgctccgactgggaccgggcaggcgctcccagggacaacagasggaggcagagggaagcccaggttcccaccctccattttgtaggctcctgcagcccgaacgccttctgcctgaaaatggcggctgagagaggccaggaggcaggatgcagggctgaggaggaagctccggggctgggtctctggtccctgggagatgctgagagatagggagatggccctgtcataggaatgtggtcccctgttttcccttgtatggaagggtgcccctgggtctccaccgtgtgctagggggtgggggcacactcaaaagtccggccaataagtgtccaggccaccccca

SEQ ID NO: 9413 - DNA, 601 bp, Human
gcagaaatgaagtcactgtgtcctcggagtcagatgcaaagccaagcgtgactctgttcattttacagaaggacagactgaagcccaagagcttaagtaacgccgccagtggctgacagagctgggagcagagtcacttctggtcactggggtttggagggaggatgtttatctgcacttcagtaccctttttgctagggtgttcacctctttcaggaggggtgcctgggagcaggcgggcgcggggagacagagctgaggaagccccccaggcctggaggaggcccgttccccactccayttggtgtgctctcgttttgcctccctccctccttcaaccaaactaaaggatgcacagttgccaaatggattcagctccttggagaaatatgttgctttgccgggatgggattctagaagtatgacaatgtctgagctggaagaaaccccagcgagctgccagccatctcctgtttgtcagaggaggaaagcaaggtgcgaagtggggaacgacatgccccagggtcttggagcagggctgagaagcccagtctttccagggcctcttcccacgctgcccagcagggcatggcggggcctg

SEQ ID NO: 9414 - DNA, 601 bp, Human
tgctagggtgttcacctctttcaggaggggtgcctgggagcaggcgggcgcggggagacagagctgaggaagccccccaggcctggaggaggcccgttccccactccacttggtgtgctctcgttttgcctccctccctccttcaaccaaactaaaggatgcacagttgccaaatggattcagctccttggagaaatatgttgctttgccgggatgggattctagaagtatgacaatgtctgagctggaagaaaccccagcgagctgccagccatctcctgtttgtcagaggaggaaagcraggtgcgaagtggggaacgacatgccccagggtcttggagcagggctgagaagcccagtctttccagggcctcttcccacgctgcccagcagggcatggcggggcctgtgtgaaccaggcacaggcttaactaactccccacccccacccctagagagaatgcgggggactgctatggcccagtgtggcctgacatggtctgacatgaacacaggtgaccctgggcagtgacatgctggcttcatgtagctactctgcccagcccctccaacggctcctccagtcctcaggctctgcctc

SEQ ID NO: 9415 - DNA, 601 bp, Human
attttccacatttgctttattatttcctctcaatgtgtctgtttttctattgctttccccctaaactgtttgagagaaggttgtaatgtccctttctcctaaataccccaacgtgtgtttttgttgttgttttttttttttacatacggacattttcttacataaccacagtgtacttatcaaaaccagataattaatgctgatacaattctattggataatcgacagaatttattcagattttgccaatggttccaataatatcttctaagacaaaagaaattttgttcagtatgctgcrtttaattctcgtctctctattctccttgaatctggaatgatttctcagattttctttctctttcatgtcattgatctttttgaagcatagagcagttattctgtaaaatggccctcatctgggttgtctgatggttcttcatggttccatttaagtcatgcctgtttggcaggaatatcacagaagcacgttttgtccttcccagtgaatcatatcaggaggcacatgggctctccatgtcccctctccggtggtctaacttgcttggctaaggtgttgtctgctagatttctctgctgt

SEQ ID NO: 9416 - DNA, 601 bp, Human
gtctcagccagcaccttcacacaacccggctgtttgttcttgaaggaggaagtttttgagtctgtggagcgtcatgggccttcagtctcaccagcaggaaggtgggtggctgatgggtgccgggctggtgttgatccacacttgtcaggtggctctgagaccagccttgactccaggctccaccacttccgccatgaccttgggcaagttcccaaagctctctgaggtaaaatgggtgtggccatgtcactcttcagcttttgcgctctaggtagatgctaaagccttccctgaagatctstatggaacttttagtcacctgcatctgtgggggctgcctcagccctaaccatgtcaacatagtgttgaaattcagttccgagaaacacttgtgggtttgtagactctatggcatctggaagtgaaagagggacacatctctccctcttacgggttccttcccccgctctcaacgcccctaatccagaatgccctagaagctcttctcagctcccaccttctgccccggaggcagcttttgttgcaggtacacctgtggtttagtttactagagttgctgcaacaaactgagtggccaggg

SEQ ID NO: 9417 - DNA, 601 bp, Human
ggggctctattgtcccagaaagttccttgtctcttgaatcctacatttccccgcctgcacgatagtgataataacagtgcttacttctgagcattgttaaggagattcaagaatttaaaactataaaaacccatggctttcttacccagagaagggcagaaaaatcgttggcagggtgcattgatatgactcggacaatttacaaaggtttttcatatatgcttttattttaaaatttttttgtttttattttgttttattttattttactaaaattttatttagtaaaaatagtacagawtttagaaaatacaaaaacagaaaaatttaaaaatttatcaatagctaccttcaaagataactgttgttactagcctcttgtagaatcttccagacatttcgttagagaggaatattgcaaacatacagaaatgcattgagaatgacatttgtttatttgtttatttgcttttgagatggtgtctcgcactgtcacccaggctggagtgcagtggtgcaatctcggctcactgcaacctttgcctcctgggttcaagtgattctcctgtctcagcctcccaagtagctgggactacaggca

SEQ ID NO: 9418 - DNA, 601 bp, Human
aaacagaaaaatttaaaaatttatcaatagctaccttcaaagataactgttgttactagcctcttgtagaatcttccagacatttcgttagagaggaatattgcaaacatacagaaatgcattgagaatgacatttgtttatttgtttatttgcttttgagatggtgtctcgcactgtcacccaggctggagtgcagtggtgcaatctcggctcactgcaacctttgcctcctgggttcaagtgattctcctgtctcagcctcccaagtagctgggactacaggcacacaccaccacaccyggctaatttttgtatttcagtagagatggggtttcaccatgttggtcacactggtcttgaactcctgatctcaagtgatccacttgcctcggccttccaaagtgctgggattacaggcgtgagccaccgcgcctggcctgagaatgttttaatgaacccaatgcgtcctcaccacccagacttagaaaatgtttacacttttgccgtatttgctcagatctatattaataagaaagaaaaccatacagatactgttgaaataattcttatcctttcctccctagaacacacactccaaag

SEQ ID NO: 9419 - DNA, 601 bp, Human
tccacaagatcttgggcatttgccatgggccaggtattgggggtttttatggtaatctttccttagccctgtgaggtttttgtttcgttttcattttagaggtggaatctcaccctgttgcccaggctggagtgcagtgatgatcatagcttactgcaacctcgaactcctgggctcaagtgatcctcctgcctcagcctcctcagtagctagaattacaagcatgtgtccagctaatttacttatttatttattcatatatatctatatatatgtatatatatatgtatatatatctatagagagagacaaaggatctcactctgttgcccaggctggagtgcagtggcaccatcttggctcactgcagcctcaaactcctcggcccaagtgatccaacctcagcctctcgactagctgggaccacaggtgcacaccaccatgtccagctaattttttgaattttggtagagacaaggttttgccttgttgcttaagctggtctcaaattcctgcgctcaagcaatccacccaccttggcctcccaaagtgctgggattacagcgtgagccacagcacccagcctcatttttttattttt

SEQ ID NO: 9420 - DNA, 601 bp, Human
tggccgggcgcggtggctcatgcctgtaatcccagcactttgggaggctgaggcagggggattgcttgagcttaggagtttgcgaccagcctgggcaacacggtgaaaccctgtctctagtaaaatacaaaaaattagccaggcgtggtggcacacacctgtagtcccagctactcaggaggctgaggcaggagaattgcttgaacctgggaggcggaggttgcagtaagccgagatcgtgccactgcagtccagcctgggcaacagagtgagactcatcccctccccaacacccccgccaaaaaaaaaaaaaaaaaaaaaaagctgaatttctttgacctgagtgactgcagtcctctggggctgggactctttgagccttaacttccatccgtctctgtcaattgagtaaattgttttatttgtgtccccaagccctgctgtggtataactggggagtgtgaaaacaaaccaaaatcctgtaacataataccaaataatactcactctctttctctttctctctcaagaaaatgaaagcacatgagccaagttctcctgaaagctgagaaatgagtttattaccgatctatgttccgtt

SEQ ID NO: 9421 - DNA, 601 bp, Human
cgggagataagtgtacatgtaaaataataccaaagcaccaaactgctgactttcctctgggcgccaggggagagaagtcactctagccttcctggccttggagagccaagtgggtataagctggtctagtcacagcagccagtcacctctgcaggctaggacagcactgtgtgactgagcctgtgacagcttcagtttcttgacaaagtaaactcagcccaaccgggtgtcacaggctcttcaagtccaagtcccctcaaaggttgaacacatttatcccctcccaattgaattatattayttgtatgagccagcgcatgcgtctttttttttttctttttctttctttctttttttttttgaaatgaagtcttgctctgtcacccagcctagaatgcagtgctgcaatctcagcacactgcaacctccccctcccggattcaagcgattctcctacctcagcctcctgagtagctgggactacaggcatgcactaccacatccagctaatttttgtatttttagtagaggctggatttcgccatgttggccaggctgatctcgaactcccgaccttagctagtccacccacctcagcctc

SEQ ID NO: 9422 - DNA, 601 bp, Human
ataccaaagcaccaaactgctgactttcctctgggcgccaggggagagaagtcactctagccttcctggccttggagagccaagtgggtataagctggtctagtcacagcagccagtcacctctgcaggctaggacagcactgtgtgactgagcctgtgacagcttcagtttcttgacaaagtaaactcagcccaaccgggtgtcacaggctcttcaagtccaagtcccctcaaaggttgaacacatttatcccctcccaattgaattatattatttgtatgagccagcgcatgcgtcttyttttttttctttttctttctttctttttttttttgaaatgaagtcttgctctgtcacccagcctagaatgcagtgctgcaatctcagcacactgcaacctccccctcccggattcaagcgattctcctacctcagcctcctgagtagctgggactacaggcatgcactaccacatccagctaatttttgtatttttagtagaggctggatttcgccatgttggccaggctgatctcgaactcccgaccttagctagtccacccacctcagcctctcaaagtgctgggattacagatgtga

SEQ ID NO: 9423 - DNA, 601 bp, Human
gtgacagcttcagtttcttgacaaagtaaactcagcccaaccgggtgtcacaggctcttcaagtccaagtcccctcaaaggttgaacacatttatcccctcccaattgaattatattatttgtatgagccagcgcatgcgtctttttttttttctttttctttctttctttttttttttgaaatgaagtcttgctctgtcacccagcctagaatgcagtgctgcaatctcagcacactgcaacctccccctcccggattcaagcgattctcctacctcagcctcctgagtagctgggactrcaggcatgcactaccacatccagctaatttttgtatttttagtagaggctggatttcgccatgttggccaggctgatctcgaactcccgaccttagctagtccacccacctcagcctctcaaagtgctgggattacagatgtgagccaccaggcccagcccgcatctttctaattttaatggaattacaggcgttcccttctttctagttgttttattaattgctcaccattaacaataccaagggcatttctaaaaagaaaatagttaggacagttccagcaccctctcactcagagct

SEQ ID NO: 9424 - DNA, 601 bp, Human
tcccctcccaattgaattatattatttgtatgagccagcgcatgcgtctttttttttttctttttctttctttctttttttttttgaaatgaagtcttgctctgtcacccagcctagaatgcagtgctgcaatctcagcacactgcaacctccccctcccggattcaagcgattctcctacctcagcctcctgagtagctgggactacaggcatgcactaccacatccagctaatttttgtatttttagtagaggctggatttcgccatgttggccaggctgatctcgaactcccgacctyagctagtccacccacctcagcctctcaaagtgctgggattacagatgtgagccaccaggcccagcccgcatctttctaattttaatggaattacaggcgttcccttctttctagttgttttattaattgctcaccattaacaataccaagggcatttctaaaaagaaaatagttaggacagttccagcaccctctcactcagagcttcctcccctaaattcattggccctcctcttccaattggccgatgcatcctcaggccctagacagtgctggagtgagccccatatttgagagcaa

SEQ ID NO: 9425 - DNA, 601 bp, Human
tggcctctgcaagcagacagcctgggttcaattcccagcttggccattttctagccgtgtaatcttaggcaagatactaaaccgctctgtgcctcagtttccccatctcgtggtcttgctttgacaattaaatcatactgaataaatgtcagccattactgctgagctgtgccagatttgtgacgggtgctcgacgtgccttggggcctcccctttccctatcagagcagtgggaagcatcacaacatccttcccttatccccctgcactctggaccccagatgcccgagataagtagctrctcccatcagtgtgggttgggagtagaaaactaggagtccatctggctgcttcccaaacctgcaaaccaggaatcccagtccagcttcccggccactgggcaaggggcaggtgagtgtttccggacagctccctgaaccagtcctgctccacttgaatacctggagtctgagccagggcctcgggaggtgggcccaccagggttcacgtagcatttgtcatcactgctcgggacaaaaggccagtcttcatacacaagatgcacggtggtctgcaggttagcagggagcacgcctctccc

SEQ ID NO: 9426 - DNA, 601 bp, Human
tgccttggggcctcccctttccctatcagagcagtgggaagcatcacaacatccttcccttatccccctgcactctggaccccagatgcccgagataagtagctactcccatcagtgtgggttgggagtagaaaactaggagtccatctggctgcttcccaaacctgcaaaccaggaatcccagtccagcttcccggccactgggcaaggggcaggtgagtgtttccggacagctccctgaaccagtcctgctccacttgaatacctggagtctgagccagggcctcgggaggtgggcccrccagggttcacgtagcatttgtcatcactgctcgggacaaaaggccagtcttcatacacaagatgcacggtggtctgcaggttagcagggagcacgcctctcccaaggttcggggacactagtcacaagggcctggtgccagtcttgcagagaggcacaccctgccctgtcctggcagtgctccagagcagcagctggactatccgggagatcactgcgctgcactgggagcctgacctccccgtgggccttggggatactcttcctttgggccgcagattttgcaatatttctgacaaa

SEQ ID NO: 9427 - DNA, 601 bp, Human
cccccaacaatgctgacattgccgagaagagacaccctgacctgccagccacatgagctcttcaattcttccctgggaatgagtatggctttagctggcgtggccacactgtctgcccaggtgctctctgcaggctcattggagcagggtgactgggtagtcagtatgaaagctcactgtattagtacttcaagctagcccacatgtccccccaggaaaaaagccctgtgtatttatttggggacttttaatttttatttgatatagaacatttgaaaaaattagaacaacacaaggcagaaaaaaaaaaaaaaaaaaggaaaacaggccaggcacagtggcttatgcctgtaatcccagcattttgggaggccaaggcaggcggatcacctgaggtcaggagttcgagaccagcctggccaacatcgtgaaacccagtctctactaatatatataaattaggcgggcatggtggcacatgcctgtagtcccagctattcaggaggctgaggcaggagaattgcttgaactcaggaggcggaggttgcagtgagttgagatggcaccactgcactccagcctgggtgacagagcaagatag

SEQ ID NO: 9428 - DNA, 601 bp, Human
tttatttggggacttttaatttttatttgatatagaacatttgaaaaaattagaacaacacaaggcagaaaaaaaaaaaaaaaaaaggaaaacaggccaggcacagtggcttatgcctgtaatcccagcattttgggaggccaaggcaggcggatcacctgaggtcaggagttcgagaccagcctggccaacatcgtgaaacccagtctctactaatatatataaattaggcgggcatggtggcacatgcctgtagtcccagctattcaggaggctgaggcaggagaattgcttgaactcrggaggcggaggttgcagtgagttgagatggcaccactgcactccagcctgggtgacagagcaagatagaaaggaaagaaagaaagagcaagaaggaaggaaggaaaacttattaataccatgtgggcatgtattttcttttcctatagtagagattaaatttaatttactgatattcttttagcatctctcctgggcaaggcactgcgcaaggtcctggatatatgggggtgatgcttagaatctagtgagccgatggttgtcagttcatgaccaggatagctatgtaattaaatgtggc

SEQ ID NO: 9429 - DNA, 601 bp, Human
atatttttctaaccaaccccccaatcacttttagacaatccagttgtctccggtttgaatttttttttggtgggtttttatttgtttgtttttattatgctatcagaaacagcacagggtcgggttctgtggctcacgcctgtaatcccagcactttgggagcctgaggtgggcggatcacttgaagccaggcgttcgagatcagcatggccaacatagtgaaaccccatctctactaaaaatataaataaaaaaattagccaggcatggtggcaggcgcctgtaaccccagctactcagkagctgcggcaggagaatcgcttgaatcaggagggtggaggtggcagtgaaccgagatcgcatcactgcactccagcctgggcaacagagggagagtgagactctatggcaaaataaaaataaaaataaatataaatataaatataaaaaaccagcacatcacagcattctggggctccagtggatggaaaagggaatctagaaccatctagttccaaagcatggactttagtctccaggcagtatggtacttgagatagttttatttaggataggttcccagatgtggaattactggatt

SEQ ID NO: 9430 - DNA, 601 bp, Human
tgcatagtttgcagggcccagtgcaaaacggagatgcagggcctttggttcaacaaatgatgaggaatttcaagatggcaacagcagaggattcaagcaaaggccgggtccttctaagcacggggccctgtgcacagtccaccagcctgtggagctggccctgcttggccccttcccctgaagcccactcttaatttttccattttgattatctgctgtgtgttctcccacacttatcttcatgttcctgcaatcataccagttcacagagggggttttttggccttgcttcacaaaaaaygtatcatattatattctcttctctgcatcttgcttttcctactcaacacagcttggaaatcctgccaacccatctgggtctatttcattctttataaaggctgcataagatgccatgctgtaaatggaccgtaattgattcagccgtttcccctgtgaatgggcattcactctgtttctaacattttgccattcaaaaatctgcagtggactgggtgcggtggctcacacctgtatgcccagcagtttgggaggctgaggcaggcagatcacttgaggtcaggtgttcaagacccaacct

SEQ ID NO: 9431 - DNA, 601 bp, Human
ttgggggattaaatttccaacacatgaaccttggaacacattcaaaccatagcaggctccttttcaaataaatttattgcagcaaaaaagtgaaccaatttaaagaaaagtgtgaggcacagggccaggcaaaagtggtaacaatgggccgggtgtggtggctcacgcctgtaatcccaacaatttgggaggctgaggtgggcagatcacttgagctcaggaatttgagaccagcctgggcaacatgggaaaaccccgtctctacaaaaaatatacaaaaattagccagcatcgtggcaarcgcctgtagtcctagctactcgggaaactgaggcacgagaatcgcttgaacccaggaggtggaggttgcagtgagccgagattgtgccactgcactccagcctgggcgacagagcgagacactgtctcaaaacaaaaaaggtgataatgatgtctgagaaacgctgatcttccattcggccctctgtgaaatgaggcctggatggaaagacggttccaggtaatttctgcttttgttcctgtagcacagaagtcagagaacagagaagccaggttcccttcttgggataggggatgggag

SEQ ID NO: 9432 - DNA, 601 bp, Human
gtggcaagcgcctgtagtcctagctactcgggaaactgaggcacgagaatcgcttgaacccaggaggtggaggttgcagtgagccgagattgtgccactgcactccagcctgggcgacagagcgagacactgtctcaaaacaaaaaaggtgataatgatgtctgagaaacgctgatcttccattcggccctctgtgaaatgaggcctggatggaaagacggttccaggtaatttctgcttttgttcctgtagcacagaagtcagagaacagagaagccaggttcccttcttgggatagggratgggagaatgcttgacacaaaaataaagccctcgaggttatccgctttcaaccagctgccttggagctggcagctgctgctcactcattcattcagtcaatcaacaaacattgccttggacactgtgggggacacagggctgacccagccatgggccctgccctctagggttttctgatctaggagaacacatttttgtctttatgcatgagaaagtggttttccagacccagagagagagatgatacagagcagagctaaagcccccctgccccacacacatcacattcacacacaca

SEQ ID NO: 9433 - DNA, 601 bp, Human
gcaggagcactgggacggttgctgtgggaaccgggattctgaaatcctaacttgtgggcatctgaattcttgcgctgaacattctaatacatcagccacagagtttatgctctgaatttggagtcatttctcctccaggggctcaggctgggcagacagccagggagttagcgaggacggcaattagagggctgaagactttctgcctgatgatgaagaggcccacacggtttcctggagagggctgtctgccagggtgtgcacgcgcacatgcacaagctcaggctcagggggtatgtcygtggaatctgctcaggtgaagctccaggaatgtgtagtggtcatgtccgagtcttcaggctctgtatcggtcaggccggactaggcaaggctgtagcaacaaggacacccccaaatcttcatggtttaacatgataagggcttactccttactcacacaaaatccaagctgggtcaacatccccttccctcttgcagttcctccgcaacccagggcctctaatatccttcaacagggaagacgtaaatggaaatggctcactgcctcttccctgctttggctcaaaagcaggcagacgtc

SEQ ID NO: 9434 - DNA, 601 bp, Human
gggctctgcagcttgctcactgggtggcctcaggcccacgcatcagttgggttcccaccaggaaacctagaataggaatttaaaggggacttatttacagaagaactatttacaaagggtaatgcagtaagtagaatctaagagcaacttctggccaaaggagacacaaccagggagtggtcagtgagtccgagtaggagacagtcaaggagaggtcaccttgaataagcaatgtccttcacatgagggacacagcctacccgagggacctcacagggggggccagaggaataagtgtcayatcttcgctctcctcacttctgcctagctctgctaaggctccccattggctgaatctgacagaagccataaggcccaggaagacaggggttaatccaaacagatcagcctcccagggcagaatggatagtagctctggtggaataaatggaccctatctggcagggacaactgatttttgcttttggagcctccttttcctaatctgtaaaataagaatgctaacacctgcctcattgcattgttgaaagtaaatggaataggccggatgcagtggctcatgcctgtaatcccggcactt

SEQ ID NO: 9435 - DNA, 601 bp, Human
tccttttcctaatctgtaaaataagaatgctaacacctgcctcattgcattgttgaaagtaaatggaataggccggatgcagtggctcatgcctgtaatcccggcactttgggaggctgaggcaggcagatcacctgaggtcaggagttcgagaccagcctgaccaacatggagaaaccccgtctctactaaaaatacaaaattagccaggcgtggtggcgcatgcctgtaatcccagctactcaggaggctgagacaggagaatcgcttgaatccgggaggtggaggttgcggtgagccragatcaagccattgcactccagcctgggcaacaagagcgaaactctgtctcaaaaaaaaaaaaagaaagaaagaaagaaagtaaatggaacaatatatgcaaatatgcaaatacctgtccttcatgaatgctagtttcttagtgtctgaaggcactttgcaatccagtggttcccagtccaggatgtgtcaattattctaaagtctgatatgaaattctcaaacaaattctataaacaaaattttctttttctaaatcactcccactttcgagctttttctatatgtcaagtatttcata

SEQ ID NO: 9436 - DNA, 601 bp, Human; identical to SEQ ID NO: 3419

SEQ ID NO: 9437 - DNA, 601 bp, Human; identical to SEQ ID NO: 3420

SEQ ID NO: 9438 - DNA, 601 bp, Human; identical to SEQ ID NO: 3421

SEQ ID NO: 9439 - DNA, 601 bp, Human; identical to SEQ ID NO: 3422

SEQ ID NO: 9440 - DNA, 601 bp, Human; identical to SEQ ID NO: 3423

SEQ ID NO: 9441 - DNA, 601 bp, Human; identical to SEQ ID NO: 3424

SEQ ID NO: 9442 - DNA, 601 bp, Human; identical to SEQ ID NO: 3425

SEQ ID NO: 9443 - DNA, 601 bp, Human; identical to SEQ ID NO: 3426

SEQ ID NO: 9444 - DNA, 601 bp, Human; identical to SEQ ID NO: 3427

SEQ ID NO: 9445 - DNA, 601 bp, Human; identical to SEQ ID NO: 3428

SEQ ID NO: 9446 - DNA, 601 bp, Human; identical to SEQ ID NO: 3429

SEQ ID NO: 9447 - DNA, 601 bp, Human; identical to SEQ ID NO: 3430

SEQ ID NO: 9448 - DNA, 601 bp, Human; identical to SEQ ID NO: 3431

SEQ ID NO: 9449 - DNA, 601 bp, Human; identical to SEQ ID NO: 3432

SEQ ID NO: 9450 - DNA, 601 bp, Human; identical to SEQ ID NO: 3433

SEQ ID NO: 9451 - DNA, 601 bp, Human; identical to SEQ ID NO: 3434

SEQ ID NO: 9452 - DNA, 601 bp, Human; identical to SEQ ID NO: 3435

SEQ ID NO: 9453 - DNA, 601 bp, Human; identical to SEQ ID NO: 3436

SEQ ID NO: 9454 - DNA, 601 bp, Human; identical to SEQ ID NO: 3437

SEQ ID NO: 9455 - DNA, 601 bp, Human; identical to SEQ ID NO: 3483

SEQ ID NO: 9456 - DNA, 601 bp, Human; identical to SEQ ID NO: 3484

SEQ ID NO: 9457 - DNA, 601 bp, Human; identical to SEQ ID NO: 3485

SEQ ID NO: 9458 - DNA, 601 bp, Human; identical to SEQ ID NO: 3486

SEQ ID NO: 9459 - DNA, 601 bp, Human; identical to SEQ ID NO: 3487

SEQ ID NO: 9460 - DNA, 601 bp, Human; identical to SEQ ID NO: 3488

SEQ ID NO: 9461 - DNA, 601 bp, Human; identical to SEQ ID NO: 3489

SEQ ID NO: 9462 - DNA, 601 bp, Human; identical to SEQ ID NO: 3490

SEQ ID NO: 9463 - DNA, 601 bp, Human; identical to SEQ ID NO: 3491

SEQ ID NO: 9464 - DNA, 601 bp, Human; identical to SEQ ID NO: 3492

SEQ ID NO: 9465 - DNA, 601 bp, Human; identical to SEQ ID NO: 3493

SEQ ID NO: 9466 - DNA, 601 bp, Human; identical to SEQ ID NO: 3494

SEQ ID NO: 9467 - DNA, 601 bp, Human; identical to SEQ ID NO: 3495

SEQ ID NO: 9468 - DNA, 601 bp, Human; identical to SEQ ID NO: 3496

SEQ ID NO: 9469 - DNA, 601 bp, Human; identical to SEQ ID NO: 3497

SEQ ID NO: 9470 - DNA, 601 bp, Human; identical to SEQ ID NO: 3498

SEQ ID NO: 9471 - DNA, 601 bp, Human; identical to SEQ ID NO: 3499

SEQ ID NO: 9472 - DNA, 601 bp, Human; identical to SEQ ID NO: 3500

SEQ ID NO: 9473 - DNA, 601 bp, Human; identical to SEQ ID NO: 3501

SEQ ID NO: 9474 - DNA, 601 bp, Human; identical to SEQ ID NO: 3502

SEQ ID NO: 9475 - DNA, 601 bp, Human; identical to SEQ ID NO: 3503

SEQ ID NO: 9476 - DNA, 601 bp, Human; identical to SEQ ID NO: 3504

SEQ ID NO: 9477 - DNA, 601 bp, Human; identical to SEQ ID NO: 3505

SEQ ID NO: 9478 - DNA, 601 bp, Human; identical to SEQ ID NO: 3506

SEQ ID NO: 9479 - DNA, 601 bp, Human; identical to SEQ ID NO: 3507

SEQ ID NO: 9480 - DNA, 601 bp, Human; identical to SEQ ID NO: 3508

SEQ ID NO: 9481 - DNA, 601 bp, Human; identical to SEQ ID NO: 3509

SEQ ID NO: 9482 - DNA, 601 bp, Human; identical to SEQ ID NO: 3510

SEQ ID NO: 9483 - DNA, 601 bp, Human; identical to SEQ ID NO: 3511

SEQ ID NO: 9484 - DNA, 601 bp, Human; identical to SEQ ID NO: 3512

SEQ ID NO: 9485 - DNA, 601 bp, Human; identical to SEQ ID NO: 3513

SEQ ID NO: 9486 - DNA, 601 bp, Human; identical to SEQ ID NO: 3514

SEQ ID NO: 9487 - DNA, 601 bp, Human; identical to SEQ ID NO: 2228

SEQ ID NO: 9488 - DNA, 601 bp, Human; identical to SEQ ID NO: 2229

SEQ ID NO: 9489 - DNA, 601 bp, Human; identical to SEQ ID NO: 2230

SEQ ID NO: 9490 - DNA, 601 bp, Human; identical to SEQ ID NO: 2231

SEQ ID NO: 9491 - DNA, 601 bp, Human; identical to SEQ ID NO: 2232

SEQ ID NO: 9492 - DNA, 601 bp, Human; identical to SEQ ID NO: 2233

SEQ ID NO: 9493 - DNA, 601 bp, Human; identical to SEQ ID NO: 2234

SEQ ID NO: 9494 - DNA, 601 bp, Human; identical to SEQ ID NO: 2235

SEQ ID NO: 9495 - DNA, 601 bp, Human; identical to SEQ ID NO: 2236

SEQ ID NO: 9496 - DNA, 601 bp, Human; identical to SEQ ID NO: 2237

SEQ ID NO: 9497 - DNA, 601 bp, Human; identical to SEQ ID NO: 2238

SEQ ID NO: 9498 - DNA, 601 bp, Human; identical to SEQ ID NO: 2239

SEQ ID NO: 9499 - DNA, 601 bp, Human; identical to SEQ ID NO: 2240

SEQ ID NO: 9500 - DNA, 601 bp, Human; identical to SEQ ID NO: 2241

SEQ ID NO: 9501 - DNA, 601 bp, Human; identical to SEQ ID NO: 2242

SEQ ID NO: 9502 - DNA, 601 bp, Human; identical to SEQ ID NO: 2243

SEQ ID NO: 9503 - DNA, 601 bp, Human; identical to SEQ ID NO: 2244

SEQ ID NO: 9504 - DNA, 601 bp, Human; identical to SEQ ID NO: 2245

SEQ ID NO: 9505 - DNA, 601 bp, Human; identical to SEQ ID NO: 2246

SEQ ID NO: 9506 - DNA, 601 bp, Human; identical to SEQ ID NO: 2247

SEQ ID NO: 9507 - DNA, 601 bp, Human; identical to SEQ ID NO: 2248

SEQ ID NO: 9508 - DNA, 601 bp, Human; identical to SEQ ID NO: 2249

SEQ ID NO: 9509 - DNA, 601 bp, Human
aaactacttatgatataatacaaactgagaaaagcagagtaatagtatatatactatgatctcacttatatcaagaaaacagtgtatggaaaagccctagaagaaaagatgctcaagtactcattgtaattccctagtctagggctcaaatatggttgagactcatttcgtatatcatgaaatcacttaagtggattttggcaagtatttgtgataatgaaatagaacagaataggagatagtaggattggacagtaaaggataggataagacaggagaatggaacaaaatagaagagaamgaacatatcagagtgcataaattataagggtaagtattgtttcttgaaacttttgtttcaattaatattatatctatatctatgtactagatggtgatttaaatgtatttcttactatagattatgcttaaaagtttaaactgtcttaagattagggttgacatttttcattgctgcgtttactctaacttccacatcttctataataaccaagtaataatttgatatttatattgtacatagttactcacgattgagaacttcctttgctaccaacatcaactttgagcaaagtaacat

SEQ ID NO: 9510 - DNA, 601 bp, Human
gtcattctttttttttttttttaaatttcagcttttattttagatatgggggcacatgtgtaggattgttaaatgggtgtgttggacccaggtagtgagcacagtacccaggaggtagtttttcaacccaggtccccctccctccctctcccctgtgctcagtgtttaacctccacttgtacgttagaacatgcagtatttggttttgggttcctgtgttaatttgcttaggattatggcctccagctccatccatgttgctccaaaggacatgattccattctttttatagctaaagttrccattgttaatgacaatgagaaagagatggaactataaaacttcacagagtgatctaaaggaagagttgaataaatagatatatcaaattcatgaattggaagattaatagaaagatgtcaattctcccaaacatgtagtcaaattctcatcaagagttttaaaattttaactatttggatgaaaaatgactaataattctaaagttttcctggaaaaatggacaagaatatctaaaagtatgttttaagggcatgtaataaagtataattaatcctattatagtttttaaaaatatggt

SEQ ID NO: 9511 - DNA, 601 bp, Human
tggtggctactactgctcctggtatttgccatggaaattctggaaattctagcatatgtggtgaggcatgaaatgaaaacgagagaggtaactataggaacgagggtcactgttgcttgtatattattattagctacttaggaaacccaagaaaatccaatgaaaaactcagagagaaagagcgtttagtgagacagatgcctatggggaaaaaaaaaacccataacaaattcaaacaatagcttccccacaaatcagtaagaaaaattttttaaagctgtcattctttttttttttttttaaatttcagcttttattttagatatgggggcacatgtgtaggattgttaaatgggtgtgttggacccaggtagtgagcacagtacccaggaggtagtttttcaacccaggtccccctccctccctctcccctgtgctcagtgtttaacctccacttgtacgttagaacatgcagtatttggttttgggttcctgtgttaatttgcttaggattatggcctccagctccatccatgttgctccaaaggacatgattccattctttttatagctaaagttgccattgttaatgacaatgaga

SEQ ID NO: 9512 - DNA, 601 bp, Human
ttctaaacaagctagttatagaatgctatatcttaaaccaagagtcaacataatgtttaacaacctgttgaggtccagatcaagtctacaatggtggctactactgctcctggtatttgccatggaaattctggaaattctagcatatgtggtgaggcatgaaatgaaaacgagagaggtaactataggaacgagggtcactgttgcttgtatattattattagctacttaggaaacccaagaaaatccaatgaaaaactcagagagaaagagcgtttagtgagacagatgcctatggggraaaaaaaaacccataacaaattcaaacaatagcttccccacaaatcagtaagaaaaattttttaaagctgtcattctttttttttttttttaaatttcagcttttattttagatatgggggcacatgtgtaggattgttaaatgggtgtgttggacccaggtagtgagcacagtacccaggaggtagtttttcaacccaggtccccctccctccctctcccctgtgctcagtgtttaacctccacttgtacgttagaacatgcagtatttggttttgggttcctgtgttaatttgcttag

SEQ ID NO: 9513 - DNA, 601 bp, Human
gaggcttaagaaaagttaagtaaacctccaaaggcatagtaaatggctgaactggaattcaaacctaggcaatctgactccagagcttgggcccttcactgctgcaccaaattcctttatcattagagtatgatctctgcaaagaacaatgtagtgtatatttcaagacacatagaagagaaggttttgaatgttatctttacaaagaaaagataaatgtttaaagtgaggaatatggtaattaccctgatcagattgtttatacaacacatgcatgcattgaaacatcacactgcacctsataaattggtacaattattatgagtcaattataaataaggaataattaaaattttttaaaaagcaaaaatgctcctggataagggttctaacattttgtaggtagttcccccaaactttcagggaaagagaattccccaagctgagtcagaatttcagaacacagaaaagatggaaagctacccagtcattttatgaggctaacatgatcagaaaaaaatatgacaatatagcataagaaattgactctatgaagagagaggaacacattcccaagtaaaattctaacaaatataatgca

SEQ ID NO: 9514 - DNA, 601 bp, Human
ttgaaggaaatggaaaattaataatggccattttttttttttactgtctgtcaggtactattgataaagctttaaataaattatcttatataatccttatattgaccttataaggtaatgcaacagaattagagcttgcagataagaaattgaggcttaagaaaagttaagtaaacctccaaaggcatagtaaatggctgaactggaattcaaacctaggcaatctgactccagagcttgggcccttcactgctgcaccaaattcctttatcattagagtatgatctctgcaaagaacaaygtagtgtatatttcaagacacatagaagagaaggttttgaatgttatctttacaaagaaaagataaatgtttaaagtgaggaatatggtaattaccctgatcagattgtttatacaacacatgcatgcattgaaacatcacactgcacctgataaattggtacaattattatgagtcaattataaataaggaataattaaaattttttaaaaagcaaaaatgctcctggataagggttctaacattttgtaggtagttcccccaaactttcagggaaagagaattccccaagctgagtca

SEQ ID NO: 9515 - DNA, 601 bp, Human
tcaatataggagattggaaaatgaacaaaaacagaaccccacgaaaaatggggtagaaaaaggtagaaatagtatttataacacaggtcaagcaataggagtagagggtggagaagagagtggacaaaaccaataacatgcatctgtttttgtaaaaatgtaaataatgcaaactaaaaatgttagcaaagataatggagattttttaaataccataagcaactttacttcaatacatttgaaaatctaaattaaatagacaactttcttgaaaaatgccaattagcataattgtcataasgaaaaatggaaataccaaaatgtaacaatcactttgaaggaaatggaaaattaataatggccattttttttttttactgtctgtcaggtactattgataaagctttaaataaattatcttatataatccttatattgaccttataaggtaatgcaacagaattagagcttgcagataagaaattgaggcttaagaaaagttaagtaaacctccaaaggcatagtaaatggctgaactggaattcaaacctaggcaatctgactccagagcttgggcccttcactgctgcaccaaattcct

SEQ ID NO: 9516 - DNA, 601 bp, Human; identical to SEQ ID NO: 2250

SEQ ID NO: 9517 - DNA, 601 bp, Human; identical to SEQ ID NO: 2251

SEQ ID NO: 9518 - DNA, 601 bp, Human; identical to SEQ ID NO: 2252

SEQ ID NO: 9519 - DNA, 601 bp, Human; identical to SEQ ID NO: 2253

SEQ ID NO: 9520 - DNA, 601 bp, Human; identical to SEQ ID NO: 2254

SEQ ID NO: 9521 - DNA, 601 bp, Human; identical to SEQ ID NO: 2255

SEQ ID NO: 9522 - DNA, 601 bp, Human; identical to SEQ ID NO: 2256

SEQ ID NO: 9523 - DNA, 601 bp, Human
ttttcaggacatttctgagcatctttctaaatgctcagaagcatttagaaacaagaccttgtttcctctatattagactgttttaaaaaattttgttatcaatcatattttggattggtggtatttagtccaaattccaaatattcgagcccattgtcagaccatgtgtctcatttttctattcttttttttttttttttgagatggagtcttgagtctctgttgccctggctggagtgcagtggcaccatcttggctcaccgcaacctctgcctcccgggttcaagtgattctcctgccycagcttcccaagtagctaggcacacgtcaccatgcctggctaatttttgtatttttagtagagacagggtttcaccatgttggccaggctggtctcaaactcctgacctctggtgatccacccgccttggcctcccaaagtactgggattacaggcgtgggacgctacacctggccatgtgtctcatttttctaatgcttatcatatgtgggccagtataaactaagccagggttataaacccaaaactgcaacactaatagagtgattctgttcttgctcatctcacatagttagtgga

SEQ ID NO: 9524 - DNA, 601 bp, Human
caaaccctctttagagtaaatgtatgcttttgatgctctatggccgtggaaaggttttcctaattccaaaatgtctatgattttcaggacatttctgagcatctttctaaatgctcagaagcatttagaaacaagaccttgtttcctctatattagactgttttaaaaaattttgttatcaatcatattttggattggtggtatttagtccaaattccaaatattcgagcccattgtcagaccatgtgtctcatttttctattcttttttttttttttttgagatggagtcttgagtctcygttgccctggctggagtgcagtggcaccatcttggctcaccgcaacctctgcctcccgggttcaagtgattctcctgcctcagcttcccaagtagctaggcacacgtcaccatgcctggctaatttttgtatttttagtagagacagggtttcaccatgttggccaggctggtctcaaactcctgacctctggtgatccacccgccttggcctcccaaagtactgggattacaggcgtgggacgctacacctggccatgtgtctcatttttctaatgcttatcatatgtgggccagtata

SEQ ID NO: 9525 - DNA, 601 bp, Human
ccatcaatgtgctgttcagatgagatgggttcaggagacccacctcatgtgcaaagacacaaataggctcaaaataaagggatggaggaatatttaccaagcaaatggaaaacaaaacaaaaaaaaagcagaagttgcaatcctaatctctgataaaacagactttaaactaacaaagatcaaaagagacaaagaaggccattacataatggtagagggatcaatgcagcaagaagagttaactatccaaaacatatatgcacccaatacaggagcacccagattcacaaagcaagttcawagagacctacaaagagacttaggctcctgcacaataatagtgggagactttaacaccccactgtcaatattagatcaacgagacagaaaattaacaaggatattcaggacttgaactcagctctggaccaagtggacctaatagccatctacagaactctccagcccaaatcaatagaatatacattcttctcagcacctcatcgcacttattctaaaattgaccacataattgaaagtaaaacactcctaagcaaaagcaaaagaatggaaatcataagtctctcataccacagtgcaa

SEQ ID NO: 9526 - DNA, 601 bp, Human
gcatcaactaacatgcaaaacaatcagctagcatcataatgacaggatcaaattcacacataacaatattaaccttaaatgtaaaggggctaaatgcccccaattaaaacacacgactggcaaattggataaagagtcaagacccatcaatgtgctgttcagatgagatgggttcaggagacccacctcatgtgcaaagacacaaataggctcaaaataaagggatggaggaatatttaccaagcaaatggaaaacaaaacaaaaaaaaagcagaagttgcaatcctaatctctgataaarcagactttaaactaacaaagatcaaaagagacaaagaaggccattacataatggtagagggatcaatgcagcaagaagagttaactatccaaaacatatatgcacccaatacaggagcacccagattcacaaagcaagttcatagagacctacaaagagacttaggctcctgcacaataatagtgggagactttaacaccccactgtcaatattagatcaacgagacagaaaattaacaaggatattcaggacttgaactcagctctggaccaagtggacctaatagccatctacagaac

SEQ ID NO: 9527 - DNA, 601 bp, Human
ggagactgcttgaacctaggaggcagaggtagcagtgagccaagatcatgtcactgcaccacttcagcttcggtgacaagagcaaaagtctgtctcaaaaaaaaaaaaaaaaagaaaagaaagaaaacataggagtaagtcttcataaccttggggtaagcaaagccttcttacatatgcacaaatgacaaaagaaaaacacttttgtgatggattgctggcaagatggccaaataggaacaactccagtgtgcagctccaagcaagattgatgcagaaggcaggtgatttctgcatttcyaactgaggtaccgggttcatctcaatgggactggttggacagtgggtgcagcccacagagggcgagctgaagcagggtggggcattgcctcacctgtgaaatgcaaggggtcggggaattttctcccctatccaagggaagccatgagggactgagcctgaggaactctggcacagatagtgcacttgtcccagggtctttgcaacctgcaaacgaggagattccctctggtgcctaccccaccagggccctgggtttcaaggacaaaactgggcagccatttgggcagacaccaaacta

SEQ ID NO: 9528 - DNA, 601 bp, Human; identical to SEQ ID NO: 2257

SEQ ID NO: 9529 - DNA, 601 bp, Human; identical to SEQ ID NO: 2258

SEQ ID NO: 9530 - DNA, 601 bp, Human; identical to SEQ ID NO: 2259

SEQ ID NO: 9531 - DNA, 601 bp, Human; identical to SEQ ID NO: 2260

SEQ ID NO: 9532 - DNA, 601 bp, Human; identical to SEQ ID NO: 2261

SEQ ID NO: 9533 - DNA, 601 bp, Human; identical to SEQ ID NO: 2262

SEQ ID NO: 9534 - DNA, 601 bp, Human; identical to SEQ ID NO: 2263

SEQ ID NO: 9535 - DNA, 601 bp, Human; identical to SEQ ID NO: 2264

SEQ ID NO: 9536 - DNA, 601 bp, Human; identical to SEQ ID NO: 2265

SEQ ID NO: 9537 - DNA, 601 bp, Human; identical to SEQ ID NO: 2266

SEQ ID NO: 9538 - DNA, 601 bp, Human; identical to SEQ ID NO: 2267

SEQ ID NO: 9539 - DNA, 601 bp, Human; identical to SEQ ID NO: 2268

SEQ ID NO: 9540 - DNA, 601 bp, Human; identical to SEQ ID NO: 2269

SEQ ID NO: 9541 - DNA, 601 bp, Human; identical to SEQ ID NO: 2270

SEQ ID NO: 9542 - DNA, 601 bp, Human; identical to SEQ ID NO: 2271

SEQ ID NO: 9543 - DNA, 601 bp, Human; identical to SEQ ID NO: 2272

SEQ ID NO: 9544 - DNA, 601 bp, Human; identical to SEQ ID NO: 2273

SEQ ID NO: 9545 - DNA, 601 bp, Human; identical to SEQ ID NO: 2274

SEQ ID NO: 9546 - DNA, 601 bp, Human; identical to SEQ ID NO: 2275

SEQ ID NO: 9547 - DNA, 601 bp, Human; identical to SEQ ID NO: 2276

SEQ ID NO: 9548 - DNA, 601 bp, Human; identical to SEQ ID NO: 5355

SEQ ID NO: 9549 - DNA, 601 bp, Human; identical to SEQ ID NO: 5354

SEQ ID NO: 9550 - DNA, 601 bp, Human; identical to SEQ ID NO: 5353

SEQ ID NO: 9551 - DNA, 601 bp, Human; identical to SEQ ID NO: 5352

SEQ ID NO: 9552 - DNA, 601 bp, Human; identical to SEQ ID NO: 5351

SEQ ID NO: 9553 - DNA, 601 bp, Human; identical to SEQ ID NO: 5350

SEQ ID NO: 9554 - DNA, 601 bp, Human; identical to SEQ ID NO: 5349

SEQ ID NO: 9555 - DNA, 601 bp, Human; identical to SEQ ID NO: 5348

SEQ ID NO: 9556 - DNA, 601 bp, Human; identical to SEQ ID NO: 5347

SEQ ID NO: 9557 - DNA, 601 bp, Human; identical to SEQ ID NO: 5346

SEQ ID NO: 9558 - DNA, 601 bp, Human; identical to SEQ ID NO: 5345

SEQ ID NO: 9559 - DNA, 601 bp, Human; identical to SEQ ID NO: 5344

SEQ ID NO: 9560 - DNA, 601 bp, Human; identical to SEQ ID NO: 1960

SEQ ID NO: 9561 - DNA, 601 bp, Human; identical to SEQ ID NO: 1961

SEQ ID NO: 9562 - DNA, 601 bp, Human; identical to SEQ ID NO: 1962

SEQ ID NO: 9563 - DNA, 601 bp, Human; identical to SEQ ID NO: 1963

SEQ ID NO: 9564 - DNA, 601 bp, Human; identical to SEQ ID NO: 1964

SEQ ID NO: 9565 - DNA, 601 bp, Human; identical to SEQ ID NO: 1965

SEQ ID NO: 9566 - DNA, 601 bp, Human; identical to SEQ ID NO: 1966

SEQ ID NO: 9567 - DNA, 601 bp, Human; identical to SEQ ID NO: 1967

SEQ ID NO: 9568 - DNA, 601 bp, Human; identical to SEQ ID NO: 1968

SEQ ID NO: 9569 - DNA, 601 bp, Human; identical to SEQ ID NO: 1969

SEQ ID NO: 9570 - DNA, 601 bp, Human; identical to SEQ ID NO: 1970

SEQ ID NO: 9571 - DNA, 601 bp, Human; identical to SEQ ID NO: 1971

SEQ ID NO: 9572 - DNA, 601 bp, Human; identical to SEQ ID NO: 1972

SEQ ID NO: 9573 - DNA, 601 bp, Human; identical to SEQ ID NO: 1973

SEQ ID NO: 9574 - DNA, 601 bp, Human; identical to SEQ ID NO: 1974

SEQ ID NO: 9575 - DNA, 601 bp, Human; identical to SEQ ID NO: 1975

SEQ ID NO: 9576 - DNA, 601 bp, Human; identical to SEQ ID NO: 1976

SEQ ID NO: 9577 - DNA, 601 bp, Human; identical to SEQ ID NO: 1977

SEQ ID NO: 9578 - DNA, 601 bp, Human; identical to SEQ ID NO: 1978

SEQ ID NO: 9579 - DNA, 601 bp, Human; identical to SEQ ID NO: 1979

SEQ ID NO: 9580 - DNA, 601 bp, Human; identical to SEQ ID NO: 1980

SEQ ID NO: 9581 - DNA, 601 bp, Human; identical to SEQ ID NO: 1981

SEQ ID NO: 9582 - DNA, 601 bp, Human; identical to SEQ ID NO: 1982

SEQ ID NO: 9583 - DNA, 601 bp, Human; identical to SEQ ID NO: 1983

SEQ ID NO: 9584 - DNA, 601 bp, Human; identical to SEQ ID NO: 1984

SEQ ID NO: 9585 - DNA, 601 bp, Human; identical to SEQ ID NO: 1985

SEQ ID NO: 9586 - DNA, 601 bp, Human; identical to SEQ ID NO: 1986

SEQ ID NO: 9587 - DNA, 601 bp, Human; identical to SEQ ID NO: 1987

SEQ ID NO: 9588 - DNA, 601 bp, Human; identical to SEQ ID NO: 1988

SEQ ID NO: 9589 - DNA, 601 bp, Human; identical to SEQ ID NO: 1989

SEQ ID NO: 9590 - DNA, 601 bp, Human; identical to SEQ ID NO: 1990

SEQ ID NO: 9591 - DNA, 601 bp, Human; identical to SEQ ID NO: 1991

SEQ ID NO: 9592 - DNA, 601 bp, Human; identical to SEQ ID NO: 1992

SEQ ID NO: 9593 - DNA, 601 bp, Human; identical to SEQ ID NO: 1993

SEQ ID NO: 9594 - DNA, 601 bp, Human; identical to SEQ ID NO: 1363

SEQ ID NO: 9595 - DNA, 601 bp, Human; identical to SEQ ID NO: 1364

SEQ ID NO: 9596 - DNA, 601 bp, Human; identical to SEQ ID NO: 1365

SEQ ID NO: 9597 - DNA, 601 bp, Human; identical to SEQ ID NO: 1366

SEQ ID NO: 9598 - DNA, 601 bp, Human; identical to SEQ ID NO: 1367

SEQ ID NO: 9599 - DNA, 601 bp, Human; identical to SEQ ID NO: 1368

SEQ ID NO: 9600 - DNA, 601 bp, Human; identical to SEQ ID NO: 1369

SEQ ID NO: 9601 - DNA, 601 bp, Human; identical to SEQ ID NO: 1370

SEQ ID NO: 9602 - DNA, 601 bp, Human; identical to SEQ ID NO: 1371

SEQ ID NO: 9603 - DNA, 601 bp, Human; identical to SEQ ID NO: 1372

SEQ ID NO: 9604 - DNA, 601 bp, Human; identical to SEQ ID NO: 1373

SEQ ID NO: 9605 - DNA, 601 bp, Human; identical to SEQ ID NO: 1374

SEQ ID NO: 9606 - DNA, 601 bp, Human; identical to SEQ ID NO: 1375

SEQ ID NO: 9607 - DNA, 601 bp, Human; identical to SEQ ID NO: 1376

SEQ ID NO: 9608 - DNA, 601 bp, Human; identical to SEQ ID NO: 1377

SEQ ID NO: 9609 - DNA, 601 bp, Human; identical to SEQ ID NO: 1378

SEQ ID NO: 9610 - DNA, 601 bp, Human; identical to SEQ ID NO: 1379

SEQ ID NO: 9611 - DNA, 601 bp, Human; identical to SEQ ID NO: 1380

SEQ ID NO: 9612 - DNA, 601 bp, Human; identical to SEQ ID NO: 1381

SEQ ID NO: 9613 - DNA, 601 bp, Human; identical to SEQ ID NO: 1382

SEQ ID NO: 9614 - DNA, 601 bp, Human; identical to SEQ ID NO: 1383

SEQ ID NO: 9615 - DNA, 601 bp, Human; identical to SEQ ID NO: 1384

SEQ ID NO: 9616 - DNA, 601 bp, Human; identical to SEQ ID NO: 1385

SEQ ID NO: 9617 - DNA, 601 bp, Human; identical to SEQ ID NO: 1386

SEQ ID NO: 9618 - DNA, 601 bp, Human; identical to SEQ ID NO: 1387

SEQ ID NO: 9619 - DNA, 601 bp, Human; identical to SEQ ID NO: 1388

SEQ ID NO: 9620 - DNA, 601 bp, Human; identical to SEQ ID NO: 1389

SEQ ID NO: 9621 - DNA, 601 bp, Human; identical to SEQ ID NO: 1390

SEQ ID NO: 9622 - DNA, 601 bp, Human; identical to SEQ ID NO: 1391

SEQ ID NO: 9623 - DNA, 601 bp, Human; identical to SEQ ID NO: 1392

SEQ ID NO: 9624 - DNA, 601 bp, Human; identical to SEQ ID NO: 1393

SEQ ID NO: 9625 - DNA, 601 bp, Human; identical to SEQ ID NO: 1394

SEQ ID NO: 9626 - DNA, 601 bp, Human; identical to SEQ ID NO: 1395

SEQ ID NO: 9627 - DNA, 601 bp, Human; identical to SEQ ID NO: 1396

SEQ ID NO: 9628 - DNA, 601 bp, Human; identical to SEQ ID NO: 1397

SEQ ID NO: 9629 - DNA, 601 bp, Human; identical to SEQ ID NO: 1398

SEQ ID NO: 9630 - DNA, 601 bp, Human; identical to SEQ ID NO: 1399

SEQ ID NO: 9631 - DNA, 601 bp, Human; identical to SEQ ID NO: 1400

SEQ ID NO: 9632 - DNA, 601 bp, Human; identical to SEQ ID NO: 1401

SEQ ID NO: 9633 - DNA, 601 bp, Human; identical to SEQ ID NO: 1402

SEQ ID NO: 9634 - DNA, 601 bp, Human; identical to SEQ ID NO: 1403

SEQ ID NO: 9635 - DNA, 601 bp, Human; identical to SEQ ID NO: 1404

SEQ ID NO: 9636 - DNA, 601 bp, Human; identical to SEQ ID NO: 1405

SEQ ID NO: 9637 - DNA, 601 bp, Human; identical to SEQ ID NO: 1406

SEQ ID NO: 9638 - DNA, 601 bp, Human; identical to SEQ ID NO: 1407

SEQ ID NO: 9639 - DNA, 601 bp, Human; identical to SEQ ID NO: 1408

SEQ ID NO: 9640 - DNA, 601 bp, Human; identical to SEQ ID NO: 2277

SEQ ID NO: 9641 - DNA, 601 bp, Human; identical to SEQ ID NO: 2278

SEQ ID NO: 9642 - DNA, 601 bp, Human; identical to SEQ ID NO: 2279

SEQ ID NO: 9643 - DNA, 601 bp, Human; identical to SEQ ID NO: 2280

SEQ ID NO: 9644 - DNA, 601 bp, Human; identical to SEQ ID NO: 2281

SEQ ID NO: 9645 - DNA, 601 bp, Human; identical to SEQ ID NO: 2282

SEQ ID NO: 9646 - DNA, 601 bp, Human
acatgacctgtccaaattcagccagttaagtaagtgacatcagtaggactcaactccaggttttctgattccaatgctttgcttcgccccaactcccatagcacaatttcctccctctgatacttcttttccttttttcttgagataaggtctcactctgttgcccaggctggactgtagtggtgcagtctctgctcactgcagccttcacctcctggggtcaagcgatctttcacctctgcttcccaagtaactgggaccctgtgctgccatgcccagctaatttttttgttttttttttgtttggtagagatggagtctcactatgttgcccaggctggtctcgaactcctagggtcaagtgattctcccacctcagcctcccaaagtgctgggattgctacagatgtgagccactgtgcctggcctgaatatacgtattgttaattctctgatttcaatggcagggactgcttatacttctaatgtatacttactgcattctggtttttgttaaaatttgatatttatggccattactttcactgattcattacccctgaaggtagggatcttgccttattttagtgccatatacaaa

SEQ ID NO: 9647 - DNA, 601 bp, Human
gataaggtctcactctgttgcccaggctggactgtagtggtgcagtctctgctcactgcagccttcacctcctggggtcaagcgatctttcacctctgcttcccaagtaactgggaccctgtgctgccatgcccagctaatttttttgttttttttttgtttggtagagatggagtctcactatgttgcccaggctggtctcgaactcctagggtcaagtgattctcccacctcagcctcccaaagtgctgggattgctacagatgtgagccactgtgcctggcctgaatatacgtattgktaattctctgatttcaatggcagggactgcttatacttctaatgtatacttactgcattctggtttttgttaaaatttgatatttatggccattactttcactgattcattacccctgaaggtagggatcttgccttattttagtgccatatacaaattcagtgcacatattttgagcaactaataggtactgagcacttatggagcttccatttagtggtaagtaaatattaattgaattttttttttcagtgtatccaaagtgtgtacatcagtaagatcataagcagtgatcgagat

SEQ ID NO: 9648 - DNA, 601 bp, Human
tcacctctgcttcccaagtaactgggaccctgtgctgccatgcccagctaatttttttgttttttttttgtttggtagagatggagtctcactatgttgcccaggctggtctcgaactcctagggtcaagtgattctcccacctcagcctcccaaagtgctgggattgctacagatgtgagccactgtgcctggcctgaatatacgtattgttaattctctgatttcaatggcagggactgcttatacttctaatgtatacttactgcattctggtttttgttaaaatttgatatttatgsccattactttcactgattcattacccctgaaggtagggatcttgccttattttagtgccatatacaaattcagtgcacatattttgagcaactaataggtactgagcacttatggagcttccatttagtggtaagtaaatattaattgaattttttttttcagtgtatccaaagtgtgtacatcagtaagatcataagcagtgatcgagatctcttggctgtggtgttctatggtaccgagaaagacaaaaattcagtgaattttaaaaatatttacgtcttacaggagctggataatcc

SEQ ID NO: 9649 - DNA, 601 bp, Human
tgatatattgtgtttttactttcatgcagttcaaaataattttaaattttctggccgggcgcgctggctcatgcctgtaatcccagcactttgggaggccgagacgggtggatcacctgaggtcagtagtgccagaccagcctggccaacatggcgaagcaccgtctctactaaaaatacaaaaattagctgggcgtggtggtgggcacctgtaatcccagctactcaggaggctgaggcaggagaatcacttgaactcgggaggcggaggttgcagtgagctgagattgcgccactgcaytccaccctaggcgacagagtgagactccatctcaaaaaaaaaaaaaaattagctgggcgcagtggcatgtgcttgtagtcccagctacttgggaggctgaggcaggagaatctcttgaacccgggaggcggaggttgcagtgagctgagattgcgccactgcactccaccctaggcgacagagtgagactccatctcaaaaaaaaaaaaattagctgggcgcagtggcatgtgcttgtagtcccagctacttgggaggctgaggcaggagaatctcttgaacccgggaggcggaggttgc

SEQ ID NO: 9650 - DNA, 601 bp, Human
aaaactgaccttgagctgggggctgtggctcacacctgtaatcccagcactttgggaggccgaggcgggcggatcacctgaggtcaggagtttgagaccagcctgaccaatatggagaaagcctgtctctactaaaaaatacaaaattagcctggtgtggtggtgggtgcctgtaatcccagctactcgggaggctgaggcaggagaatcacttgaacccgggaggtggaggttgcagtgtggagatcgtgccattgcactccagcctgggcaacaagagcgaaactccatctttaaaaamaaaaaacaaaaaacaaaaaaaaacaaacaaaaaaggctgaccttgactaatttcagcgtatgagtcaaataattagttctaggaatctacgtagcaggaactaatgacagtgtctttagggtgccattatgagaagaaagtatcctctggaatcacatcctttcatggccactgctcagagaccccgactctcagatgagaacgtcctatggccttctccagggtcagatatgcccaccacttggccagaagaaggcacagcaacttgagtttgactaacattctcccaaaactgtagtc

SEQ ID NO: 9651 - DNA, 601 bp, Human
tctcatttaataaatagatgtggtggccgggtgcggtggctcacgcctgtaatcccagcactttgggaggctgaggcgggcggatcacgaggtcaggagatcgagaccatcccggctaacacagtgaaaccccatctctactaaaaatacaaaaaaattagccaggtgtggtggcgggcacctatagtcccagctactcgtggggctgaggcaggagaatggcgtgaaccccggtgggtggagcctgcagtgagccgagatcgctgcctgggtgacagcgagactgtctcaaaaaaaaaataataataaataaataaataaatagatatggtttgggctgggcacagtggctcacacctgtaatcccagctagtcaggaggctgatgcaggagaatcacttgaacctgggaggttgccgtgagtcgagattgcgccactgcacgccagtgacagtgtgacagactgcatctcaaataataaataataataaatagatatggtttaagcatgctttgtgtgtcagggatggtgctgacaggtcagtacatttttttttttctttttttgggttggggggatagagttgctctggtacccagg

SEQ ID NO: 9652 - DNA, 601 bp, Human
tgggtgacagcgagactgtctcaaaaaaaaaaaaataataaataaataaataaatagatatggtttgggctgggcacagtggctcacacctgtaatcccagctagtcaggaggctgatgcaggagaatcacttgaacctgggaggttgccgtgagtcgagattgcgccactgcacgccagtgacagtgtgacagactgcatctcaaataataaataataataaatagatatggtttaagcatgctttgtgtgtcagggatggtgctgacaggtcagtacatttttttttttctttttttgkgttggggggatagagttgctctggtacccaggttgcagtgcagtggcgccatcttggcacactgcatcctcgaactcctgggctcaagcgatcctccagtctcagcctcccaagtagctgggaccacaggtgtgtaccactataccgagctaatttttaatttttttatacagatagggtcttgccatgttgtccaggctggtcttgaactcctgggctcaagcagtcttgcctcagctctcaaagtgctgggattacaggcatgaggcactgcacctagcctattttattgtttttgca

SEQ ID NO: 9653 - DNA, 601 bp, Human
ctatgttgggcaggctggtctcaaactcctgggcttaagcaatctacctgtcttggcctcccagagtgctaggactgtaagcgtgagccacctcacctggccaataattcactttctgtttgtttgttttgaaacagagtctcactctgtcgcccaggctggaatgcagtggcaatgtctctgctctctgcaagctccgcctcctgaattcaagcgattcttctgcctcagcctcccaagtagctgggactacaggcgtgcactaccatgcccagctaatttttgtatttttagtagagayggggttttaccatactggccaggttggtctcgaactcctgaccttgtgatccacccgcctgtgcctcccaaagtgctgggattacaggcgtgagccaccatgcccggccataattcactttcttaagtggaatgtttggggcttctaaacctcttattcctttttaaattttcctttctgtgtctctgctgtccccattttcccctcagctgtggggtcctccaacccttacctgttgagatattataagccctttaaaggcttggtgtggtggctcatgcctgtaatcccaacactttg

SEQ ID NO: 9654 - DNA, 601 bp, Human
tctctgttgtgctgtacttagccagattagttggttgaacaaatttgaaaaaatagcaggattcttattcgcccttctccttgattgtgtttgttattccacaatgagcaaaagtaaataaatctagtgtaaattgttaaaggcttaaaagaatgattaagtaattcaagtcattccctctcacatatataatagaccaactctcagagcctgcataatgggacactaaacgtaatttttttcacatgtcatttttaaaaatttattattattattattattattattattattattattattattattttgagacagggtctcttgtcacccaggtttgattgcagtggtgttactgtagttcactgcagccttgacctccctgggctcaggtgattctcccacctcagactcctgagtagctgggaccatacccttgcaccaccacacctggctaatttttgtattttttgtagggacggagtttcaccatgttgcccaggctggtctggaactcctgagctcaagccatccgcctgcctcagcttctcaaagtgctggattacaggcatgagccagggtgcccaggctggtttgcttt

SEQ ID NO: 9655 - DNA, 601 bp, Human
tctgccatccaggctggagtaccgtggcacgatcatggctcactgcagcctcgatctcctggactcaagcagtcttcctgcctatgcctcctgagtagctgggaccacaggcgtgcaccaacatgcctggctgatttttaaattttttgtagagacagggtctcaccatgttgtccaagctggtcttgaactgctagactcaagcattccgcctaccttggcctaccaaagtgctgggattacaggcatgggctactgcacctgacctcaactgttttacttggggtgtttttctcagctyaccccggacctgtagtatctcaggtggttttattctaattttttcaatgtttaaattgtcatgtttcagttgagttacattattgttttaacagaagtgacagctttgagaaccccgtgctgcagcagcacttcaggaacctggaggccttggccttggatttgatggagccggaacaagcagtggacctgacatgtaaggaggttgaatagagtagttcttttcatgggaggctttcttactggttccactctgcaccagtaatttgggtgcatttcccagtcctctctaaacacttaa

SEQ ID NO: 9656 - DNA, 601 bp, Human
atatccacacttacctatctcattttttaaaaaatgaggctgcagagtagttcattggatagatataccaggttatttaaccagacctgtattgacaggtggatatgctgcagtgaacatgcatttccatcgtgttcttgtgtgaatagatccacaggatgcattcttgcagtgaattgcttccaaaacagtgatttaccctctatccaagaaggagtgaatgttttcctgcactctcacccttccaggacttaatttttttaatttctatttaaaatgatacagaagttggccaggtgcrgtggctcacacctgtaatcccagcactttgggagcctgaggtgggcggatcatgaggtcaggagttcaagaccagcctggccaacacagtgaaacctcgtctgtactaaaaatacaaaaattagccagatgtggtagtgggcgcctgtagtcccaactacctgggagactgaggtaggagaatcccttgaacccgggaggcagaggttgcagtgagccgagaccacaccattgcactccagcctcggtgatagagtgagactccatctcaaaaatgatacagaagttatatccttttttt

SEQ ID NO: 9657 - DNA, 601 bp, Human
aaatgaggctgcagagtagttcattggatagatataccaggttatttaaccagacctgtattgacaggtggatatgctgcagtgaacatgcatttccatcgtgttcttgtgtgaatagatccacaggatgcattcttgcagtgaattgcttccaaaacagtgatttaccctctatccaagaaggagtgaatgttttcctgcactctcacccttccaggacttaatttttttaatttctatttaaaatgatacagaagttggccaggtgcggtggctcacacctgtaatcccagcactttgrgagcctgaggtgggcggatcatgaggtcaggagttcaagaccagcctggccaacacagtgaaacctcgtctgtactaaaaatacaaaaattagccagatgtggtagtgggcgcctgtagtcccaactacctgggagactgaggtaggagaatcccttgaacccgggaggcagaggttgcagtgagccgagaccacaccattgcactccagcctcggtgatagagtgagactccatctcaaaaatgatacagaagttatatcctttttttgtttttagacagtcttgctctgtcacccagg

SEQ ID NO: 9658 - DNA, 601 bp, Human
ttcttgtgtgaatagatccacaggatgcattcttgcagtgaattgcttccaaaacagtgatttaccctctatccaagaaggagtgaatgttttcctgcactctcacccttccaggacttaatttttttaatttctatttaaaatgatacagaagttggccaggtgcggtggctcacacctgtaatcccagcactttgggagcctgaggtgggcggatcatgaggtcaggagttcaagaccagcctggccaacacagtgaaacctcgtctgtactaaaaatacaaaaattagccagatgtgrtagtgggcgcctgtagtcccaactacctgggagactgaggtaggagaatcccttgaacccgggaggcagaggttgcagtgagccgagaccacaccattgcactccagcctcggtgatagagtgagactccatctcaaaaatgatacagaagttatatcctttttttgtttttagacagtcttgctctgtcacccaggctggagtccagtggctcaatcacagttcactggctcactgtagcctcaacctcctgggctcgagtgatcctgcagcctcagcctgctgagtagctgagactgc

SEQ ID NO: 9659 - DNA, 601 bp, Human
accttatcgagataagtcttccccatggtgtcctaggctggcatcacagctttatggttaattgcagcccagattatacgaggtcccccatgccatgtagctgggatgccacttgtatgtagcatttccagtcactctctcctgacctttccccccagataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtggkctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactatatactgttcttttgtgtgaaggag

SEQ ID NO: 9660 - DNA, 601 bp, Human; identical to SEQ ID NO: 1303

SEQ ID NO: 9661 - DNA, 601 bp, Human; identical to SEQ ID NO: 1304

SEQ ID NO: 9662 - DNA, 601 bp, Human; identical to SEQ ID NO: 1305

SEQ ID NO: 9663 - DNA, 601 bp, Human; identical to SEQ ID NO: 1306

SEQ ID NO: 9664 - DNA, 601 bp, Human; identical to SEQ ID NO: 1307

SEQ ID NO: 9665 - DNA, 601 bp, Human; identical to SEQ ID NO: 1308

SEQ ID NO: 9666 - DNA, 601 bp, Human; identical to SEQ ID NO: 1321

SEQ ID NO: 9667 - DNA, 601 bp, Human; identical to SEQ ID NO: 1322

SEQ ID NO: 9668 - DNA, 601 bp, Human; identical to SEQ ID NO: 1323

SEQ ID NO: 9669 - DNA, 601 bp, Human; identical to SEQ ID NO: 1324

SEQ ID NO: 9670 - DNA, 601 bp, Human; identical to SEQ ID NO: 3139

SEQ ID NO: 9671 - DNA, 601 bp, Human; identical to SEQ ID NO: 3140

SEQ ID NO: 9672 - DNA, 601 bp, Human; identical to SEQ ID NO: 3141

SEQ ID NO: 9673 - DNA, 601 bp, Human; identical to SEQ ID NO: 3142

SEQ ID NO: 9674 - DNA, 601 bp, Human; identical to SEQ ID NO: 3143

SEQ ID NO: 9675 - DNA, 601 bp, Human; identical to SEQ ID NO: 3144

SEQ ID NO: 9676 - DNA, 601 bp, Human; identical to SEQ ID NO: 3145

SEQ ID NO: 9677 - DNA, 601 bp, Human; identical to SEQ ID NO: 3146

SEQ ID NO: 9678 - DNA, 601 bp, Human; identical to SEQ ID NO: 3147

SEQ ID NO: 9679 - DNA, 601 bp, Human; identical to SEQ ID NO: 3148

SEQ ID NO: 9680 - DNA, 601 bp, Human; identical to SEQ ID NO: 3149

SEQ ID NO: 9681 - DNA, 601 bp, Human; identical to SEQ ID NO: 3150

SEQ ID NO: 9682 - DNA, 601 bp, Human; identical to SEQ ID NO: 3151

SEQ ID NO: 9683 - DNA, 601 bp, Human; identical to SEQ ID NO: 3152

SEQ ID NO: 9684 - DNA, 601 bp, Human; identical to SEQ ID NO: 3153

SEQ ID NO: 9685 - DNA, 601 bp, Human; identical to SEQ ID NO: 3154

SEQ ID NO: 9686 - DNA, 601 bp, Human; identical to SEQ ID NO: 3155

SEQ ID NO: 9687 - DNA, 601 bp, Human
agataagaaggctttgggaatgcatcttttggaagtagtgaatagttctactttactagacaaggctgccaaactaaggttttgaggcttttttatagacaatgtgaagccatttatggtttttgagaaacagagggagcagaattttgtgttttcaatggatcatttgaacaggagtgaagaagtctgttcaaaaaaaaagactgagaaatttgttgagagaccattacaatggcccacatgaatgtcaataaagccctgctcgggggaatgcacagtgaagaataaacaggaaaaattmcttcaaaagaagaaacaataagacttggcaaaggtttgactatgcaaatagtggggaagtcagagttttgagtccaaacatgtggcagaattggtgtagtcaatcttatttggaagatcaagaatagaaagatgatagcttcaacactgagtatctgaagtttttcagtataacactggatagaactggaaaaaacaaacttggggatcatcagctcttaagcggtactaaaagccatgggaaaggaagacaatccatggcaaattgcatagaaaagacagaaggtccacaccaaggctt

SEQ ID NO: 9688 - DNA, 601 bp, Human
atttttagtagagacggggttttaccatgttggccaggttggtcttaaactcctaatctcaagtgatctgcccacctcagcctcccaaagtgctgggattacaggcatgagccaccacgcccagctggtattttttataagtgactcgatatattatgtattcagtttatttgaacctctcttgaacctgataacattttcagccctttccatcccttagggcaacatattccaagagctccaatccaaggtggattagaaccacagaatttgtaaaatggagaattcaggagtcgtctarttttttcattttatacatgagaggtgaaactcagaatggtacagcaatttgccagtgcttgagtatgcatatttttccccaaacccatctacattccaacttggagggatgccctttaaacaatctttctgcttgtgctcacctttaacttcccctcaagggttcgagaacgcttgaagcctgagttcttggtctcagccttgatggcactgatggctcctgacttcaccagctgctttgcctgctctgttgctgtggctgtgtccatgacaggctgctctgatagtgctggagagacaa

SEQ ID NO: 9689 - DNA, 601 bp, Human; identical to SEQ ID NO: 1759

SEQ ID NO: 9690 - DNA, 601 bp, Human; identical to SEQ ID NO: 1758

SEQ ID NO: 9691 - DNA, 601 bp, Human; identical to SEQ ID NO: 1757

SEQ ID NO: 9692 - DNA, 601 bp, Human; identical to SEQ ID NO: 1756

SEQ ID NO: 9693 - DNA, 601 bp, Human; identical to SEQ ID NO: 1755

SEQ ID NO: 9694 - DNA, 601 bp, Human; identical to SEQ ID NO: 1754

SEQ ID NO: 9695 - DNA, 601 bp, Human; identical to SEQ ID NO: 1755

SEQ ID NO: 9696 - DNA, 601 bp, Human; identical to SEQ ID NO: 1756

SEQ ID NO: 9697 - DNA, 601 bp, Human; identical to SEQ ID NO: 1757

SEQ ID NO: 9698 - DNA, 601 bp, Human; identical to SEQ ID NO: 1758

SEQ ID NO: 9699 - DNA, 601 bp, Human; identical to SEQ ID NO: 1759

SEQ ID NO: 9700 - DNA, 601 bp, Human
tttgttatccagtctctcttgcatggttgcccgtgtttctggagacttgtgtaaacattaatggatgaggaggagagatggttctcagagcccagccctcatctctgctggcttcccactgccctcaggcatctggtgaatgctggagtcctcaccgtccgagatgctgggagctggtggctagctgtgcctggagctgggagattcatcaagtactttgttaaaggtatcccatctgcagctcaagcctgcagcccctcaccttttggtggctcctcaggcctctaggccttattcacckttcccctttcctgtgccacttctcctctagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactggtgagtctttccctggcctctggcagattatggagcaatgacccaaagtgggatttcctcccagctcatgcttagtttcctagtgaaggccagtggctctcattcttctctggaacccggga

SEQ ID NO: 9701 - DNA, 601 bp, Human
ccagtctctcttgcatggttgcccgtgtttctggagacttgtgtaaacattaatggatgaggaggagagatggttctcagagcccagccctcatctctgctggcttcccactgccctcaggcatctggtgaatgctggagtcctcaccgtccgagatgctgggagctggtggctagctgtgcctggagctgggagattcatcaagtactttgttaaaggtatcccatctgcagctcaagcctgcagcccctcaccttttggtggctcctcaggcctctaggccttattcacctttcccctytcctgtgccacttctcctctagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactggtgagtctttccctggcctctggcagattatggagcaatgacccaaagtgggatttcctcccagctcatgcttagtttcctagtgaaggccagtggctctcattcttctctggaacccgggagcacccct

SEQ ID NO: 9702 - DNA, 601 bp, Human
gtgtaaacattaatggatgaggaggagagatggttctcagagcccagccctcatctctgctggcttcccactgccctcaggcatctggtgaatgctggagtcctcaccgtccgagatgctgggagctggtggctagctgtgcctggagctgggagattcatcaagtactttgttaaaggtatcccatctgcagctcaagcctgcagcccctcaccttttggtggctcctcaggcctctaggccttattcacctttcccctttcctgtgccacttctcctctagggcgccaggctgtccttrgcatggtccggaaggcaaagtaccgggaactgctcctatcagagctcctgggccggcgggcgcctgtcgtggtgcggcttggcctcacctaccatgtgcacgacctcattggggcccagctagtggactggtgagtctttccctggcctctggcagattatggagcaatgacccaaagtgggatttcctcccagctcatgcttagtttcctagtgaaggccagtggctctcattcttctctggaacccgggagcaccccttcccaagttctaagttctcctcacagcttgagcctaggcg

SEQ ID NO: 9703 - DNA, 601 bp, Human
atggttctcagagcccagccctcatctctgctggcttcccactgccctcaggcatctggtgaatgctggagtcctcaccgtccgagatgctgggagctggtggctagctgtgcctggagctgggagattcatcaagtactttgttaaaggtatcccatctgcagctcaagcctgcagcccctcaccttttggtggctcctcaggcctctaggccttattcacctttcccctttcctgtgccacttctcctctagggcgccaggctgtccttagcatggtccggaaggcaaagtaccgggarctgctcctatcagagctcctgggccggcgggcgcctgtcgtggtgcggcttggcctcacctaccatgtgcacgacctcattggggcccagctagtggactggtgagtctttccctggcctctggcagattatggagcaatgacccaaagtgggatttcctcccagctcatgcttagtttcctagtgaaggccagtggctctcattcttctctggaacccgggagcaccccttcccaagttctaagttctcctcacagcttgagcctaggcgtctggctccagccttgtctttctcctgca

SEQ ID NO: 9704 - DNA, 601 bp, Human
ggcttcccactgccctcaggcatctggtgaatgctggagtcctcaccgtccgagatgctgggagctggtggctagctgtgcctggagctgggagattcatcaagtactttgttaaaggtatcccatctgcagctcaagcctgcagcccctcaccttttggtggctcctcaggcctctaggccttattcacctttcccctttcctgtgccacttctcctctagggcgccaggctgtccttagcatggtccggaaggcaaagtaccgggaactgctcctatcagagctcctgggccggcgggygcctgtcgtggtgcggcttggcctcacctaccatgtgcacgacctcattggggcccagctagtggactggtgagtctttccctggcctctggcagattatggagcaatgacccaaagtgggatttcctcccagctcatgcttagtttcctagtgaaggccagtggctctcattcttctctggaacccgggagcaccccttcccaagttctaagttctcctcacagcttgagcctaggcgtctggctccagccttgtctttctcctgcacagcatctctaccacttcaggaaccctcctcc

SEQ ID NO: 9705 - DNA, 601 bp, Human
ggtaggaaggagaataggggctggggaggggaaggggcaagggaggtgaggtgggagactcagtctcaccctatgtcctgtttctttctatgccccagctggtgaatggacagagccacatttccctctcaaaggcagagttccaggacgccctggagaagctgaatatgggcattactgacctccaggggctgcgcctctacgttgctgcagccatcattgagtatccaggtgggtgactttcccttattgtaaccccagacccttgcctctgacctctgagctaaccctctgtcctccrgcaccaacaccaccccacttctcacatctcatctcagactcaaaaccaggaaacacccaggagacctggtttctctccaactctgtctctgtgactcggcccttttccctggctgagtttatttatttctttgctcgttctgctcattccttcactcctccagtggacatgtgttgttcaatgccccgtgctaggcctcagcatgcacagacatgttggggaccagcctcaacgccacccgtagggttcctgaagtccattggtgacacaggaatgagaagagacaggttaagagttcat

SEQ ID NO: 9706 - DNA, 601 bp, Human
tgaagtccattggtgacacaggaatgagaagagacaggttaagagttcataaagagtgggggccagggggccaattgcaaaatggaggctgcaaaaggctcagagctctggtctccacactattttttgagtacagtcactcagatctaagaagcagatgttcagggagaaacagtgaaagggaggcagtgggtcataggcgtaatctatagcaatagagttttaaatgaatctcctttgtgctcaaacagcatgtctttaaattatcggagagtagctggtggaagtgggcttagctagragactgcatgtctgtccaatgcttcaaaggagggtctttctccttgaacacagtgtttacagataagacagggggtctcactctgagcatgggaacatgatggcaattaggaggcttttcttctcagaggcctcttgtggctttccacaacttattgtctcatatttttatggccagtttatacaggcaccccacaagtccttttcccaacatgcccccctccctttttttttttttaaccgctattgctattatggcttatttgtggtgtttggtctgttttcagaagtgtcttttgca

SEQ ID NO: 9707 - DNA, 601 bp, Human
aagcagatgttcagggagaaacagtgaaagggaggcagtgggtcataggcgtaatctatagcaatagagttttaaatgaatctcctttgtgctcaaacagcatgtctttaaattatcggagagtagctggtggaagtgggcttagctagaagactgcatgtctgtccaatgcttcaaaggagggtctttctccttgaacacagtgtttacagataagacagggggtctcactctgagcatgggaacatgatggcaattaggaggcttttcttctcagaggcctcttgtggctttccacaayttattgtctcatatttttatggccagtttatacaggcaccccacaagtccttttcccaacatgcccccctccctttttttttttttaaccgctattgctattatggcttatttgtggtgtttggtctgttttcagaagtgtcttttgcatctgtagactaaaagtaaacagcataaacagatacacattaaagtaaaatttgtaatagttgatcctttaatggtcttaatctgtttaagaggatttatgtttgaaagtccgtcagtagctccaatgagaatgtcagtctcaggcaggagg

SEQ ID NO: 9708 - DNA, 601 bp, Human
gtgaaagggaggcagtgggtcataggcgtaatctatagcaatagagttttaaatgaatctcctttgtgctcaaacagcatgtctttaaattatcggagagtagctggtggaagtgggcttagctagaagactgcatgtctgtccaatgcttcaaaggagggtctttctccttgaacacagtgtttacagataagacagggggtctcactctgagcatgggaacatgatggcaattaggaggcttttcttctcagaggcctcttgtggctttccacaacttattgtctcatatttttatggmcagtttatacaggcaccccacaagtccttttcccaacatgcccccctccctttttttttttttaaccgctattgctattatggcttatttgtggtgtttggtctgttttcagaagtgtcttttgcatctgtagactaaaagtaaacagcataaacagatacacattaaagtaaaatttgtaatagttgatcctttaatggtcttaatctgtttaagaggatttatgtttgaaagtccgtcagtagctccaatgagaatgtcagtctcaggcaggagggttaaatgagcctgagatgcttt

SEQ ID NO: 9709 - DNA, 601 bp, Human
aaatgaatctcctttgtgctcaaacagcatgtctttaaattatcggagagtagctggtggaagtgggcttagctagaagactgcatgtctgtccaatgcttcaaaggagggtctttctccttgaacacagtgtttacagataagacagggggtctcactctgagcatgggaacatgatggcaattaggaggcttttcttctcagaggcctcttgtggctttccacaacttattgtctcatatttttatggccagtttatacaggcaccccacaagtccttttcccaacatgcccccctccstttttttttttttaaccgctattgctattatggcttatttgtggtgtttggtctgttttcagaagtgtcttttgcatctgtagactaaaagtaaacagcataaacagatacacattaaagtaaaatttgtaatagttgatcctttaatggtcttaatctgtttaagaggatttatgtttgaaagtccgtcagtagctccaatgagaatgtcagtctcaggcaggagggttaaatgagcctgagatgctttaaaaacctgtttttttaaaatttggttatatttaatgttaaatttttatt

SEQ ID NO: 9710 - DNA, 601 bp, Human
agacagggggtctcactctgagcatgggaacatgatggcaattaggaggcttttcttctcagaggcctcttgtggctttccacaacttattgtctcatatttttatggccagtttatacaggcaccccacaagtccttttcccaacatgcccccctccctttttttttttttaaccgctattgctattatggcttatttgtggtgtttggtctgttttcagaagtgtcttttgcatctgtagactaaaagtaaacagcataaacagatacacattaaagtaaaatttgtaatagttgatcmtttaatggtcttaatctgtttaagaggatttatgtttgaaagtccgtcagtagctccaatgagaatgtcagtctcaggcaggagggttaaatgagcctgagatgctttaaaaacctgtttttttaaaatttggttatatttaatgttaaatttttatttttttcttttagatgatgtctaactttttaaaaatgatgtttagtagtattatacgaatggggagttatgtagaaattggaagtatttcaattacattgtacttctaattgatgttttaagtttattgtacgatcttccatt

SEQ ID NO: 9711 - DNA, 601 bp, Human
ggcaggaatgggacacatgcccaataggtataattttgggctgttgtagccacaggtttgttaggcgaggaggtcactgtttttattttggctttgtattctaggattagtaaataacagaagacaaacatgagtataattagtaacttttttttttagtaaaagagtgacctgtagtgttacttggcatcttagtttactatatgttattaatgaggaaccccactgggggtatgttaatttattctagctaagcagttatgttattagaagctgagaagggggtgtttgttaaagtaasagggcagaagaaaggcggatttaagatacgagcttaatacagtgtagcaggtataggtagtaggcaaagtgagagaattaaaaatgaataaattatttggcttagacttttgtttttttagtataatgtctgaggcctgtgttgtttgtggaagtcgcattgttgaggctgtagttcctgtagggtcttttttaggctggttcaaatgtttttttattttttaattttttatcctttgatgaggatgtagtctttaggctggtactggaaattttaggagtggcgtctgtgttaagagac

SEQ ID NO: 9712 - DNA, 601 bp, Human
attaatgaggaaccccactgggggtatgttaatttattctagctaagcagttatgttattagaagctgagaagggggtgtttgttaaagtaacagggcagaagaaaggcggatttaagatacgagcttaatacagtgtagcaggtataggtagtaggcaaagtgagagaattaaaaatgaataaattatttggcttagacttttgtttttttagtataatgtctgaggcctgtgttgtttgtggaagtcgcattgttgaggctgtagttcctgtagggtcttttttaggctggttcaaatktttttttattttttaattttttatcctttgatgaggatgtagtctttaggctggtactggaaattttaggagtggcgtctgtgttaagagactttttacaatttttaaagagcaggttagtgttttaagaaaaacttgtgttttattttaatgtttagtttatagaaaactggatgatatctttttaactttagtaaatacgtttacacacggaattttttacaattatcattttaaaacttgtttagatctttaaaacaaaattaaacaaccttttttgtataaattttttataacttt

SEQ ID NO: 9713 - DNA, 601 bp, Human
ttagtaaattcagatcaagtgattggattatgtggtctccaccagactgttgctttttcatgtttaccagacccaccagtaaaaacagctatggctccttccaaaggggcatcacaagtaatttttggaagaacctatgtagttaattttaagaattgaaaagtttttaggataatgattattaatacatccaacaaattttgttaaattaatctgtcatgtaactgagttaataaatgcctgtttaacctgatttttatttattggaactataatttttattgggctcagtgccacaaartttaataattcatatatgagcctgtccaattagaattgccatctgatttaagtatactgtaagtgcttttatggtattatgtggcaaaaaggaccatttaactaaatcatcattttgaacaataacccccattattgtgtggttagtgtgaagtagggaacacaatgaattataaaggcaagtctgagtcaatcctactgacctgggcttgctgaattttgttttcaattactgataactctttcatggcctcgggtgttagttctctgttactgcgtaagttggtatttcccctcaata

SEQ ID NO: 9714 - DNA, 601 bp, Human
agacatagcataagtaggaattgctaaattgggccaaatccaattaatatcttctaacaatttttgaaaattatttaaggttttgaaagaatctcttctaatttgaaccttttgaggcttaatggctctatcctgtacttgtattttcaaatactgaaaaggagtggttgtttgaattttgtcaggtgctataagtaattcagcatttgtaattgtcttttgcaaagattaataatattgaataagttggtctctactttttgctgcacaaatctggaaactgatctctaacaggctggakagttctgcctacaaaagtttgacaaactgtgggactatttaacataccctggggcaaaactttccaatgatatttggctgcaggttttttgttattaacggcaggaatggtaaaggcaaattttttgaaatctgcctctgctaaaggaattgtaaaaaagcagtcttttaaatctataataacaagcggtcagtctttagggagcacagtgggggatgggagcccaggttgtaaggctcccatcggttgaattacagcgttgacgccatctaccggactttttcttaattacaaatactg

SEQ ID NO: 9715 - DNA, 601 bp, Human
atttgaaccttttgaggcttaatggctctatcctgtacttgtattttcaaatactgaaaaggagtggttgtttgaattttgtcaggtgctataagtaattcagcatttgtaattgtcttttgcaaagattaataatattgaataagttggtctctactttttgctgcacaaatctggaaactgatctctaacaggctggatagttctgcctacaaaagtttgacaaactgtgggactatttaacataccctggggcaaaactttccaatgatatttggctgcaggttttttgttattaacrgcaggaatggtaaaggcaaattttttgaaatctgcctctgctaaaggaattgtaaaaaagcagtcttttaaatctataataacaagcggtcagtctttagggagcacagtgggggatgggagcccaggttgtaaggctcccatcggttgaattacagcgttgacgccatctaccggactttttcttaattacaaatactggggaattccaaggagagaaagtgggtgaaatatatcctttttttagtagtttattttataaagcacccccaacttttccttagggagcggccactgttca

SEQ ID NO: 9716 - DNA, 601 bp, Human
tgcaaagattaataatattgaataagttggtctctactttttgctgcacaaatctggaaactgatctctaacaggctggatagttctgcctacaaaagtttgacaaactgtgggactatttaacataccctggggcaaaactttccaatgatatttggctgcaggttttttgttattaacggcaggaatggtaaaggcaaattttttgaaatctgcctctgctaaaggaattgtaaaaaagcagtcttttaaatctataataacaagcggtcagtctttagggagcacagtgggggatggragcccaggttgtaaggctcccatcggttgaattacagcgttgacgccatctaccggactttttcttaattacaaatactggggaattccaaggagagaaagtgggtgaaatatatcctttttttagtagtttattttataaagcacccccaacttttccttagggagcggccactgttcaacccagacggggcgccgggtcatccattttaagggaaattgctccttcactgtaataactgtagggtgaacctgaattgccccatctccataatgaactgtgggtcgggcaataatgggc

SEQ ID NO: 9717 - DNA, 601 bp, Human
cgtttcctcaccagattcttttgggccccacgttgggcgccagaatgttggggaccagcctcaacaccacctgtagggtacctgaagtctggtggtgacaaaggaatgagaagagacaggttaagagttcataaagagtggaggccagggggccaattgcaaaatggaggctgcaaaaggctcagagctctggtctccacactatttattgagtacaataacttagatctaagaagcagatgttcagggcaaaacagtgaaagggtagcagtgcgtcacaggcataatctacagcagaagygctttaaatgaatctcctttgtgctcaaacagcatatctttaacttatcggagagtagctagtgggagtgggcttaactaggagcctgcacgtctgtccacattccaatgcttcaaaggagggtctttctccttgaatacagtgtttacagataagagagagcaggtctcgctctgagcatggcaattaggaggcttttctcctcagaggcctcttgtggctttccacaacttattgtcccatatttttatggccagtttatacaggcaccccacaagtccttttcccaacacagacagg

SEQ ID NO: 9718 - DNA, 601 bp, Human
ccccgactcctcctcctcctcctgccctccctctgcgtcttgagtatgcggctagtgcgcccttcctctctcccggggccgcacctgcgaccccaggacccctcccgggccctgtcctgcgccctccacgcgtcgcccctgctgggagtccgctttcgttgcacccctccgcgtcccaccccaccccaccaaggatgcccaggataccgggcatttgccactgcaagatgtgagtcgttgctaagtttgagggtcacattcctccaggtccaccccgccttgcaaaaccggctcaccagcygggtgctcaggttcgggatctccagcccgcccccttgaggtcccctgggattagcccccctcgacctgcgtcagggtcacagactgcagccggggctggagcggcctacacccctccggatccgctgcgtggaggcaggagggggaaggggcgaggggacgtggccgcggagacagaagggtgcaccctcccagggtcggagaggggagatactgggaagatactccgcgaatatggagaggcgatcggcacttgcatttcaaccctgagcaaatcaatccgttacacgcagtagcgagt

SEQ ID NO: 9719 - DNA, 601 bp, Human
gggatctccagcccgcccccttgaggtcccctgggattagcccccctcgacctgcgtcagggtcacagactgcagccggggctggagcggcctacacccctccggatccgctgcgtggaggcaggagggggaaggggcgaggggacgtggccgcggagacagaagggtgcaccctcccagggtcggagaggggagatactgggaagatactccgcgaatatggagaggcgatcggcacttgcatttcaaccctgagcaaatcaatccgttacacgcagtagcgagttgactccatcagccsgtttatttggttagcgatggttatattgactctgagtattcccacctcctttcttttaacatttttttttttatttccttgttttgtttagcaagaagtcttagaaacgaatatagcatgcttgggcgttgattcagtggtgagaagtgccggagctggctcagggagaggtggagtttcccatgtgtgctcactggcccaggggctaagtcccactgcttgccaaggtttctcagtatcctgtccacccaccccctatccacctgtgcaggcttgagggggtgagggggtagcagatac

SEQ ID NO: 9720 - DNA, 601 bp, Human
cagccggggctggagcggcctacacccctccggatccgctgcgtggaggcaggagggggaaggggcgaggggacgtggccgcggagacagaagggtgcaccctcccagggtcggagaggggagatactgggaagatactccgcgaatatggagaggcgatcggcacttgcatttcaaccctgagcaaatcaatccgttacacgcagtagcgagttgactccatcagcccgtttatttggttagcgatggttatattgactctgagtattcccacctcctttcttttaacatttttttttttatttccttgttttgtttagcaagaagtcttagaaacgaatatagcatgcttgggcgttgattcagtggtgagaagtgccggagctggctcagggagaggtggagtttcccatgtgtgctcactggcccaggggctaagtcccactgcttgccaaggtttctcagtatcctgtccacccaccccctatccacctgtgcaggcttgagggggtgagggggtagcagatactctatcaaaatctaccctaaggaaaatattcgataaacactcctagcaattagggcatagctgataaggctt

SEQ ID NO: 9721 - DNA, 601 bp, Human
cgataaacactcctagcaattagggcatagctgataaggcttgatctgtttgtcgcagaaaatgacttgaacttgtaagttctattgttcataaagttgttttccacaattttagataatcaaaaatgtacatgactcatttttcttacctattatttcctctaaagtttctcatgtatttattgaaaagttaaagaaaatctgattttggttcacataatttgacaatggtgatttgtctaaaagtcatttcaaaaagtagtatgaaaaggatcataaccctagaggtactgtcatagamgtgaaacatttattaaaatatatattccatggctcacacttgcacactcaaagccacattggactcattttttctgctacctttataaaccttcaaactgttcaagagtcaatggtatgtatcatcttccgttatcaatcatcatgttttgttttgtttggtttggtttggtttggtttggtttttgacaaagtctcgctctgtcgcgcaggctggagtgcagtggcactgtcttggctcactgcaacctccccctcctgggttcaagcgattcttctgcctcagcctcttgagtagctg

SEQ ID NO: 9722 - DNA, 601 bp, Human
ccatgccaccagaatgaaagcattctgatttcagaaattctcaaatgttaaaagaaaatgggcattttataatttgtgaaatattagtgagttagagcagagcttgacggcactggccctgagggtccttcttcttcctttggaagaatgaaactgggggctatgcaattcagggaagaataaaggaaaaacaggtaattggcagaggaggttggctgacttagaggtatggaaaagacaaaacaaaggagggaaaaagagaggtatgtatgatggggaggagttcagagccactgaaaaytttctctggccctaacaggaaaacgagttaccccacaagccagggttttatcatctggtacgtggagatatccatcagcattgtcattggttttcatttgtttgtttttaattctcaagtttaaaaaaaaatttaaaatttaaatgtgtctcaaccaccagaaactatagtgagatttctctgtaataaataggaaagaaggagactgatccagtccttgttaaaaaaaaaaaaaagaggaaactgaatcacaacatactttgcttttttcttttctcacaaaggaacagtgggcccttt

SEQ ID NO: 9723 - DNA, 601 bp, Human
caggagaaagaacagaagcaatactgctgaaaataaaagtattttaatagaagaaagcccagtaaggaagcccagtaaattcaactgaaaagggacaaagattaagaagaaagaagctattatgaaagacaaaatacaatcaagaattgggaccactgaagtcccagatgtagagaagtcaacaaatgggacagaaaattcaaataaaaataagtccaaagaaagcttattgagatgaagaaaaaatggtctgtaggccaaaggaacatgccatgttccagaaaatgtcatgtgggaatayggaagcactacgatatcttaaactatttaaattcaaagaaaaagatttaggaatctaagaagaaaaagtaaaggagggaaaaacaaaatcaagctcgcctcagacttcagtgcagcactaaatgccagactatgatggttgtgaggaaacagttccaagggaaagaaacttttccgaggggcatattttttttccggaagaacaaagggaattcagcacccatgaaccgtttttggaaaaacaaaaacttgctgagtaataaaatccaggaaatagcaaattaagagataaatcaaaata

SEQ ID NO: 9724 - DNA, 601 bp, Human
cagagaggaagatggaaggaaacatgagaataccaatattctcttctttcaaagaatggaatagtaaatatggtataaaattaaaagatgctatgtgaatatataatactgcaacttttaatatctttcataagttttatttaaaaccttagagggatatcataggaaattatactttcttatggacaaaaaaatttaaattttaacaactcctttgactttattttagtcttttcccaagtaacattaaacagaaacactgtgtgtgtgtgtgtgtgtgtgtgtgtgtgtgtgtgtgtgtgtgtttatgcatagaaagatctgtgggattatgttcgcctaatattaatgatagtaatagtttttacagaagaaaaaagaaagatgtttgaaaaataagctagaatcaaatatgccaagatgttaacaattgttgatgctggatggtaggaataaggatgagtgttactttcttatttgtactttttcatatttttctaatttccagaaaaagatatgtaattgtttttgtctaacatttctgaatccacttcattcattattcattgcctccttgacaatgtgcatcagtctatgtcaa

SEQ ID NO: 9725 - DNA, 601 bp, Human
caaaattggggttcagcctgggaagccacatgagttgttggcttcgcacaggatggaattaaagagcaagctgacagaattaagtgaaagcaagtttattaagaaagtcaaggaatgaaagggtggctactccataggcagagcagcagcatgggctgctccactaagtatacttatggttatttcttgatcatatgctaaacaagtggtggattattcataagttgtctgcaaaaggggtgggagttctggaactgagggttcctcacttttttcgatgatatagggtaacttctgcatrttgccatggcatttgtaaactgtggtggcactggtgggagtttcctttagcatgctaatatattgtaattagcatatgataagcagtgaggacagttttgtcaccatcttggttttggcaggctttggccagcttctttactgcgtcctgtcttatcagcagggtctttgtgacctcctgttttatcacataactaagaatgcctaaccccctgggaatgcagcccagcaggtctcagcctcattttacccagctgctactcaagatggagtcactctggttccaacacctctgacaaga

SEQ ID NO: 9726 - DNA, 601 bp, Human
attaagtgaaagcaagtttattaagaaagtcaaggaatgaaagggtggctactccataggcagagcagcagcatgggctgctccactaagtatacttatggttatttcttgatcatatgctaaacaagtggtggattattcataagttgtctgcaaaaggggtgggagttctggaactgagggttcctcacttttttcgatgatatagggtaacttctgcatgttgccatggcatttgtaaactgtggtggcactggtgggagtttcctttagcatgctaatatattgtaattagcatatrataagcagtgaggacagttttgtcaccatcttggttttggcaggctttggccagcttctttactgcgtcctgtcttatcagcagggtctttgtgacctcctgttttatcacataactaagaatgcctaaccccctgggaatgcagcccagcaggtctcagcctcattttacccagctgctactcaagatggagtcactctggttccaacacctctgacaagagcagggggtgacctgtcacctggggctcagcaggacaataactctaggaaaaactggaaaggctgatagccttgaatt

SEQ ID NO: 9727 - DNA, 601 bp, Human
aagagcatttaattcatatatggaattgccaagttataccattagtactttacagcacatcttgggaggttcccttgaactagccagaagaagcaaactgaagccagacagaggaagattgcaaagaggaagagagggtctccaccaggcacagagccacccaagggagccctccctcaggctcagggataccgagggagccagagcagattcacacaggtccctggggcccctctgccctggtgactctaggatgcatgtacttgcacctgacttctaggcatccccctcctgctagctwcccctcgatccagcctggggcaggctctgtggaagtcaagccttgcatctccctttcccaagcacctaccatcctaacccacagtgtagtggccacgtccaagggtctttacgtctctgcctcagatatgctaggtacctgggtcaagagtgacccagagactcatccctgccagacccaacctccagccagtcaccctctgactccagtccatggggcgaggctggagtgctggccctgacctctccagcatctgcaccaggagggcttcagcggaatgtggtcccagttgatgcccca

SEQ ID NO: 9728 - DNA, 601 bp, Human
cacatcttgggaggttcccttgaactagccagaagaagcaaactgaagccagacagaggaagattgcaaagaggaagagagggtctccaccaggcacagagccacccaagggagccctccctcaggctcagggataccgagggagccagagcagattcacacaggtccctggggcccctctgccctggtgactctaggatgcatgtacttgcacctgacttctaggcatccccctcctgctagcttcccctcgatccagcctggggcaggctctgtggaagtcaagccttgcatctccctytcccaagcacctaccatcctaacccacagtgtagtggccacgtccaagggtctttacgtctctgcctcagatatgctaggtacctgggtcaagagtgacccagagactcatccctgccagacccaacctccagccagtcaccctctgactccagtccatggggcgaggctggagtgctggccctgacctctccagcatctgcaccaggagggcttcagcggaatgtggtcccagttgatgccccatgccaacagtagcagcagcagttgttaggcatagagattgaagccagacagggcc

SEQ ID NO: 9729 - DNA, 601 bp, Human
gtggaagtcaagccttgcatctccctttcccaagcacctaccatcctaacccacagtgtagtggccacgtccaagggtctttacgtctctgcctcagatatgctaggtacctgggtcaagagtgacccagagactcatccctgccagacccaacctccagccagtcaccctctgactccagtccatggggcgaggctggagtgctggccctgacctctccagcatctgcaccaggagggcttcagcggaatgtggtcccagttgatgccccatgccaacagtagcagcagcagttgttagscatagagattgaagccagacagggcctgggattcctctgctgggagcctaaactgcaggagatggggaaggatccaagtgtgagctggggctcctagcacaaaactcacattgaaagataaaatggttaagaatttcaggatagccacaggagaacctcaagccaagtgtaggatccttctagctgcagggcctgggggtactgagactagccctgttgacaggagccatgctttaggaagactgatctatttgtagtcagcaagagttttaaggagctccattaacaatttaggcacga

SEQ ID NO: 9730 - DNA, 601 bp, Human
agaatttcaggatagccacaggagaacctcaagccaagtgtaggatccttctagctgcagggcctgggggtactgagactagccctgttgacaggagccatgctttaggaagactgatctatttgtagtcagcaagagttttaaggagctccattaacaatttaggcacgatgccaagatgggatattatattttccaagcaagaagaatctggtaatcaggcatatggttccaagtgaagtataagtcaccagaaagcaaggaaggaagccatcccctggcccagagggggagaatgggrtgtgtgtgtgtgtgtgtgtgtgtgtgtgtgttttctcggctgctgaagagactgagtgttcctgcagatatataacaaagatgaagatgtgccaccgttggagacaaatggggaccagaggccacatgtcagaggtcaggtcaggtgttcaaatataaaggggttgccctggctgggcatggtggctcacatccataatccaagccctttgtggggctgaggccggaggatcacttgagcccaagagttcaagaccagcctggacaacatagcaaagccccatctctaaaaaaaaaaata

SEQ ID NO: 9731 - DNA, 601 bp, Human
ttagggaagaggagtcaggctgggggtctaggggaaagcaaagagataaagcagataagccataggtctaccttgcttcatggtccaggacatacaaacaaaaagaagaagcagataagctataggtctgcctttctttatggcccaggacatacgaccctcctgcacacataactcacaatcttcctgcgtatcatcaaatgcttcaacttatcatcaaacatctcggctgaccgaaaaatgcaagttagctccctgctaccttggcgttgtcagtcctccacatagcactcttcagctyaaattgcattttataaaatccccagcaagcctttgtctcctggcagtcaactcgtctcttactgacctgcccattgctcccttgcaatgtattttcctactttctctaataaatctgcctttcttgacctaaactgtcatggtaaattcttcttactcctatgtcaccagccacagacagtcgccacaagccatgacaagtctgcgatttcatggtctttttttattttgatgatatttccccagtgtttgggggacagaagaatgcccacaatctataggtcttagtcacatggatggg

SEQ ID NO: 9732 - DNA, 601 bp, Human
caagtgacaaactggggagagaagaaaaagatgtgactcatatcacagtttcccttctacttaaaaaaaaaaaaaactgcaaaccagtaagaaaatagcaacagctcaacagaaaaattgccaaaggcacgaacagttaatgagaaggagatgcaaatcgctcttaaacctatgaaaagatgaaggtgttccatcacaaagagtaagagaaatacaaattaatattaatgtgaaagacaacttttcatttatgaatttgagaaaaatccaagaacttgatgatatacctctaagaagcaayggtagggaaacgaaaattctcacacattgcaggtggttatgtaaattggtatagccccgcgggtggtcagtgtgacagtttctatccaaattacagatgcatagtttcattgccaggtctcttctgtctgcttcttcagacccaccctcccctctccccactgtttagttggcccaggaccctgtctggtaaggatacaactccaggccccttgccctatggcttctggttgtgttcagccgatggggagccccaaataagagaaggaagggacaccgtgagtgatatttatccctcagc

SEQ ID NO: 9733 - DNA, 601 bp, Human
agtgacaaactggggagagaagaaaaagatgtgactcatatcacagtttcccttctacttaaaaaaaaaaaaaactgcaaaccagtaagaaaatagcaacagctcaacagaaaaattgccaaaggcacgaacagttaatgagaaggagatgcaaatcgctcttaaacctatgaaaagatgaaggtgttccatcacaaagagtaagagaaatacaaattaatattaatgtgaaagacaacttttcatttatgaatttgagaaaaatccaagaacttgatgatatacctctaagaagcaacgktagggaaacgaaaattctcacacattgcaggtggttatgtaaattggtatagccccgcgggtggtcagtgtgacagtttctatccaaattacagatgcatagtttcattgccaggtctcttctgtctgcttcttcagacccaccctcccctctccccactgtttagttggcccaggaccctgtctggtaaggatacaactccaggccccttgccctatggcttctggttgtgttcagccgatggggagccccaaataagagaaggaagggacaccgtgagtgatatttatccctcagctt

SEQ ID NO: 9734 - DNA, 601 bp, Human
atgtgaaagacaacttttcatttatgaatttgagaaaaatccaagaacttgatgatatacctctaagaagcaacggtagggaaacgaaaattctcacacattgcaggtggttatgtaaattggtatagccccgcgggtggtcagtgtgacagtttctatccaaattacagatgcatagtttcattgccaggtctcttctgtctgcttcttcagacccaccctcccctctccccactgtttagttggcccaggaccctgtctggtaaggatacaactccaggccccttgccctatggcttcyggttgtgttcagccgatggggagccccaaataagagaaggaagggacaccgtgagtgatatttatccctcagcttcctgcctgcactgtcctcttggtctggctgtgtccagtggtctcatgtcatagctgctcatacaggagtttctccttacaaattgcaatgttggcttctcttccccctccggcccagagtgattacagccatcaatgttgtgagctacaggttctataccctcccttctgcaggcccagaatggtaacagccctcaatgttgtgagctgcaggttctgtactctc

SEQ ID NO: 9735 - DNA, 601 bp, Human
tttcatttatgaatttgagaaaaatccaagaacttgatgatatacctctaagaagcaacggtagggaaacgaaaattctcacacattgcaggtggttatgtaaattggtatagccccgcgggtggtcagtgtgacagtttctatccaaattacagatgcatagtttcattgccaggtctcttctgtctgcttcttcagacccaccctcccctctccccactgtttagttggcccaggaccctgtctggtaaggatacaactccaggccccttgccctatggcttctggttgtgttcagccratggggagccccaaataagagaaggaagggacaccgtgagtgatatttatccctcagcttcctgcctgcactgtcctcttggtctggctgtgtccagtggtctcatgtcatagctgctcatacaggagtttctccttacaaattgcaatgttggcttctcttccccctccggcccagagtgattacagccatcaatgttgtgagctacaggttctataccctcccttctgcaggcccagaatggtaacagccctcaatgttgtgagctgcaggttctgtactctccctcctggggcccag

SEQ ID NO: 9736 - DNA, 601 bp, Human
aatttgagaaaaatccaagaacttgatgatatacctctaagaagcaacggtagggaaacgaaaattctcacacattgcaggtggttatgtaaattggtatagccccgcgggtggtcagtgtgacagtttctatccaaattacagatgcatagtttcattgccaggtctcttctgtctgcttcttcagacccaccctcccctctccccactgtttagttggcccaggaccctgtctggtaaggatacaactccaggccccttgccctatggcttctggttgtgttcagccgatggggagccscaaataagagaaggaagggacaccgtgagtgatatttatccctcagcttcctgcctgcactgtcctcttggtctggctgtgtccagtggtctcatgtcatagctgctcatacaggagtttctccttacaaattgcaatgttggcttctcttccccctccggcccagagtgattacagccatcaatgttgtgagctacaggttctataccctcccttctgcaggcccagaatggtaacagccctcaatgttgtgagctgcaggttctgtactctccctcctggggcccagagtggtcacag

SEQ ID NO: 9737 - DNA, 601 bp, Human
attacagatgcatagtttcattgccaggtctcttctgtctgcttcttcagacccaccctcccctctccccactgtttagttggcccaggaccctgtctggtaaggatacaactccaggccccttgccctatggcttctggttgtgttcagccgatggggagccccaaataagagaaggaagggacaccgtgagtgatatttatccctcagcttcctgcctgcactgtcctcttggtctggctgtgtccagtggtctcatgtcatagctgctcatacaggagtttctccttacaaattgcartgttggcttctcttccccctccggcccagagtgattacagccatcaatgttgtgagctacaggttctataccctcccttctgcaggcccagaatggtaacagccctcaatgttgtgagctgcaggttctgtactctccctcctggggcccagagtggtcacagccctcaatgttgtgagctacaggttctatactctcctttctgcaggcccagagtggtgacagccctcaatgttgtgagctacagctctcaatgttgtgagctacaggttctataccctccattctgcagacccagaa

SEQ ID NO: 9738 - DNA, 601 bp, Human
ctccttacaaattgcaatgttggcttctcttccccctccggcccagagtgattacagccatcaatgttgtgagctacaggttctataccctcccttctgcaggcccagaatggtaacagccctcaatgttgtgagctgcaggttctgtactctccctcctggggcccagagtggtcacagccctcaatgttgtgagctacaggttctatactctcctttctgcaggcccagagtggtgacagccctcaatgttgtgagctacagctctcaatgttgtgagctacaggttctataccctccrttctgcagacccagaatgttacagccctcaatgttgtgatctgcaggttctgtactctccctcctggggcccagagtggtcacagccctcaatgttgtgagctacaggttctatattctcccttctgcaggcccagagtggtcacagccctcaatgttgtgagctacaggttctatattctcccttctgcaggcccagagtggtcacagccctcaatgttgtgagctacaggttctatattctcccttctgcaggcccagagtggtcacagccctcaatgttgtgagctacaggttctat

SEQ ID NO: 9739 - DNA, 601 bp, Human
taaagaaaatgtggctaggtgtggtgctcacatctgtaatcccagcactttgggaggccaaggcgagaatccaggagtttgagatcagcctgggcaacatagtgagaccctatctctacaaaaaaaaggtttttttaattagccggtgtgtgatgacacatacctgtagtctcagctacttagggggacaggtgggaggattgcttgagcctgggaggttgaggctgcagtgagccatgattgcaccactggcactccaggctaggcaacacagcaagacccgtctcaaaaaaaaaaaaaagttacatatatatacacacagtatattcagccataaaaaagaatgaaatcgtgtttttgcagcaacatggatggaactggaggccattatcttaagagaaacaactcagaaacagtcaataccacatgttcttataagtgggagctattaataaaaaatgtgcacacattgacatatatataatgtggaatgatagtcattactgactgagaagggtggattgggtgtggggagttaaggaatgagaaattacttaatgggtataatgtatactattcaggtgatggatacactaaaagc

SEQ ID NO: 9740 - DNA, 601 bp, Human
aagagactggaaataattcaaatgtctatagtaggggtactaattatataaataatggtgtgtctatagagtagaactgtatccagctatttaaaaaacaaggatagaaagatcttccaaacatatttttaagtggaaaaagcagggtggaacagggactatacatgctatctcttgtctaaaagatggggaaattaggaatatgtatttgtttttgcttatgcatgaagatactctgaaggattcacaaaagaaaaaaaagttttctaaagggagcaagacttttcacaattttttttttgaatgcttaaaattgttgaacccaacgactgttgcctgttcaaaagttaaatttaaaattcctcccagactaggtaggggattgggcccagaagctgagaccaggctcacttgaataaatggggtaaatgactaggaattttactattccttacaggtctctcattatcttgtctttgctcccatttttatatttgcagtttaattagacacttcagaattttgatcacctaatgttgatttcagatgtaaaagtcaagagaagactctaaaaatagcaaagatgcttttgagccagaat

SEQ ID NO: 9741 - DNA, 601 bp, Human
tgtctatagtaggggtactaattatataaataatggtgtgtctatagagtagaactgtatccagctatttaaaaaacaaggatagaaagatcttccaaacatatttttaagtggaaaaagcagggtggaacagggactatacatgctatctcttgtctaaaagatggggaaattaggaatatgtatttgtttttgcttatgcatgaagatactctgaaggattcacaaaagaaaaaaaagttttctaaagggagcaagacttttcacaattttttttttgaatgcttaaaattgttgaacmcaacgactgttgcctgttcaaaagttaaatttaaaattcctcccagactaggtaggggattgggcccagaagctgagaccaggctcacttgaataaatggggtaaatgactaggaattttactattccttacaggtctctcattatcttgtctttgctcccatttttatatttgcagtttaattagacacttcagaattttgatcacctaatgttgatttcagatgtaaaagtcaagagaagactctaaaaatagcaaagatgcttttgagccagaatgccttcatcttcagatcactta

SEQ ID NO: 9742 - DNA, 601 bp, Human; identical to SEQ ID NO: 1349

SEQ ID NO: 9743 - DNA, 601 bp, Human; identical to SEQ ID NO: 1350

SEQ ID NO: 9744 - DNA, 601 bp, Human; identical to SEQ ID NO: 1351

SEQ ID NO: 9745 - DNA, 601 bp, Human; identical to SEQ ID NO: 1352

SEQ ID NO: 9746 - DNA, 601 bp, Human; identical to SEQ ID NO: 1353

SEQ ID NO: 9747 - DNA, 601 bp, Human; identical to SEQ ID NO: 1354

SEQ ID NO: 9748 - DNA, 601 bp, Human; identical to SEQ ID NO: 1355

SEQ ID NO: 9749 - DNA, 601 bp, Human; identical to SEQ ID NO: 1356

SEQ ID NO: 9750 - DNA, 601 bp, Human; identical to SEQ ID NO: 1357

SEQ ID NO: 9751 - DNA, 601 bp, Human; identical to SEQ ID NO: 1358

SEQ ID NO: 9752 - DNA, 601 bp, Human; identical to SEQ ID NO: 1359

SEQ ID NO: 9753 - DNA, 601 bp, Human; identical to SEQ ID NO: 1360

SEQ ID NO: 9754 - DNA, 601 bp, Human; identical to SEQ ID NO: 1361

SEQ ID NO: 9755 - DNA, 601 bp, Human; identical to SEQ ID NO: 1362

SEQ ID NO: 9756 - DNA, 601 bp, Human
gaggggcccgctgggagcccgcagcggggctgggatgggcggccaggagttccagacaggagctgggcagcagcaggaagacggggggcacccctcctggcgtcctggccgccgggacacccctctccgggagaggacactcggtgcccctccgtgaagccggtaacctcggctgcgccacctcccccacccgcgcgcccgcgccgggaaagccagcgtggccccagtctccgaatttctcggaatgaacaacagcaaattgaatccagggctccggcgggggccgcctttgctggccackggttctgcagcctggcgagactgcgcttagtccccgcctggagtgcctcccgaaggcctggctggaagctagactcagtccctttgtagtagcagcggtggagcagggaccagcgtcttggacgggtgacccagactcaattccgactttggccgagggcatgtttgacactgggtgtgaaatctagacagttcccgcggtcatagagatggggcagcagcattcaggcagggctcagaactgtccgggtcccatcagtgttggggcggaagaggaagagtgtcaactgagccaggcatt

SEQ ID NO: 9757 - DNA, 601 bp, Human
gcaaattgaatccagggctccggcgggggccgcctttgctggccactggttctgcagcctggcgagactgcgcttagtccccgcctggagtgcctcccgaaggcctggctggaagctagactcagtccctttgtagtagcagcggtggagcagggaccagcgtcttggacgggtgacccagactcaattccgactttggccgagggcatgtttgacactgggtgtgaaatctagacagttcccgcggtcatagagatggggcagcagcattcaggcagggctcagaactgtccgggtcccrtcagtgttggggcggaagaggaagagtgtcaactgagccaggcatttatttattttattgttgtttgagacagggtgtcgctctgtcgcccaggctggagtgcagtgggcagcatctcagctactgcagcctccgcctcccgtgctcaagcgatcctcccacgtcagcctcccaagaaggtggtattattggccacgcctggccaatttttgtattttttgtagagaggaggtctcactgtgttgcccaggctgttcttgtactcctgagctccagcaatccacccgccttggcctctga

SEQ ID NO: 9758 - DNA, 601 bp, Human
gaccagcagaactataagaaaataaatttagatgtgattttttaaaatttatttatttttagagatggggggatctcgctatgttggccaggctagagtgcaatgattattcacaggcatgatcatagcacatgcactacagcctcgaactcctgggctccagtgatcctcccgcctcagccccttgagcagctgggactacaggtgcgcaccaccacgcccagctaaatctgggttgtgtggagtcactaggttagtgataatgtgttacagtgataagaagaacctaatacaggaaatraaaggagttgtcagattctttgaatgcccaaccctaagcagacactcaccctgttcctggaaagagccgggtccagctgcgttttctcatggcccaataacaagaagcagacaaactaggaagaaagagaatttattgctgtaacaggaaggtcggagataatccgaccagaccaactcaaagtgtttgattttctttgtgcttacataggtttgggttatgtgcctatgtgtggtattgcactaagtctatgagtaactaattttgtttcaactagaaagtcagaggccaaaaatgtgc

SEQ ID NO: 9759 - DNA, 601 bp, Human
tgtggaaatttctctgcatagttcggatgctattcagatctgtctgtgtgactgtcatgcaggcctctctgtgtgactgtgagggagcattgacctgccaccacccccctctggaagcatccagtccccaactggctttgggcattgctaggtcatagcagccacagcacacctggtgggcctgcctcttgccacgcagctttacctgtctgccttcggcccaggatgtcatgaggcctgctgtgtgtcaggagaagtgttgttagctggttgggtgaaggtcacccagagctcataggtktggaggggaggggcatcctataactaaacaaatggccgcagacttggcaattcatctttcagaagaagagccagtggtcaggctgtcagctgatctctttgaggttgagcgcatttaccgaaaatgtgtggcttgaatttcctgctttgaattttggaacagcatgtttttcaaacctttcttccaccttctgggcatttcttattaatctttttggtcaaaagccttatcttgattatgttttctttctaagacaaagggctccctgtgaagtacctgcttgggaaagggaggagttgt

SEQ ID NO: 9760 - DNA, 601 bp, Human; identical to SEQ ID NO: 3316

SEQ ID NO: 9761 - DNA, 601 bp, Human; identical to SEQ ID NO: 3317

SEQ ID NO: 9762 - DNA, 601 bp, Human; identical to SEQ ID NO: 3318

SEQ ID NO: 9763 - DNA, 601 bp, Human; identical to SEQ ID NO: 3319

SEQ ID NO: 9764 - DNA, 601 bp, Human; identical to SEQ ID NO: 3320

SEQ ID NO: 9765 - DNA, 601 bp, Human; identical to SEQ ID NO: 3321

SEQ ID NO: 9766 - DNA, 601 bp, Human; identical to SEQ ID NO: 3322

SEQ ID NO: 9767 - DNA, 601 bp, Human; identical to SEQ ID NO: 3323

SEQ ID NO: 9768 - DNA, 601 bp, Human; identical to SEQ ID NO: 3324

SEQ ID NO: 9769 - DNA, 601 bp, Human; identical to SEQ ID NO: 3325

SEQ ID NO: 9770 - DNA, 601 bp, Human; identical to SEQ ID NO: 3326

SEQ ID NO: 9771 - DNA, 601 bp, Human; identical to SEQ ID NO: 3327

SEQ ID NO: 9772 - DNA, 601 bp, Human; identical to SEQ ID NO: 3328

SEQ ID NO: 9773 - DNA, 601 bp, Human; identical to SEQ ID NO: 3329

SEQ ID NO: 9774 - DNA, 601 bp, Human; identical to SEQ ID NO: 3330

SEQ ID NO: 9775 - DNA, 601 bp, Human; identical to SEQ ID NO: 3331

SEQ ID NO: 9776 - DNA, 601 bp, Human; identical to SEQ ID NO: 3332

SEQ ID NO: 9777 - DNA, 601 bp, Human; identical to SEQ ID NO: 3333

SEQ ID NO: 9778 - DNA, 601 bp, Human; identical to SEQ ID NO: 3334

SEQ ID NO: 9779 - DNA, 601 bp, Human; identical to SEQ ID NO: 3335

SEQ ID NO: 9780 - DNA, 601 bp, Human; identical to SEQ ID NO: 3336

SEQ ID NO: 9781 - DNA, 601 bp, Human; identical to SEQ ID NO: 3337

SEQ ID NO: 9782 - DNA, 601 bp, Human; identical to SEQ ID NO: 3338

SEQ ID NO: 9783 - DNA, 601 bp, Human; identical to SEQ ID NO: 1231

SEQ ID NO: 9784 - DNA, 601 bp, Human; identical to SEQ ID NO: 1232

SEQ ID NO: 9785 - DNA, 601 bp, Human; identical to SEQ ID NO: 1233

SEQ ID NO: 9786 - DNA, 601 bp, Human; identical to SEQ ID NO: 1234

SEQ ID NO: 9787 - DNA, 601 bp, Human; identical to SEQ ID NO: 1235

SEQ ID NO: 9788 - DNA, 601 bp, Human; identical to SEQ ID NO: 1236

SEQ ID NO: 9789 - DNA, 601 bp, Human; identical to SEQ ID NO: 1237

SEQ ID NO: 9790 - DNA, 601 bp, Human; identical to SEQ ID NO: 1238

SEQ ID NO: 9791 - DNA, 601 bp, Human; identical to SEQ ID NO: 1239

SEQ ID NO: 9792 - DNA, 601 bp, Human; identical to SEQ ID NO: 1240

SEQ ID NO: 9793 - DNA, 601 bp, Human; identical to SEQ ID NO: 1241

SEQ ID NO: 9794 - DNA, 601 bp, Human; identical to SEQ ID NO: 1242

SEQ ID NO: 9795 - DNA, 601 bp, Human; identical to SEQ ID NO: 1243

SEQ ID NO: 9796 - DNA, 601 bp, Human; identical to SEQ ID NO: 1325

SEQ ID NO: 9797 - DNA, 601 bp, Human; identical to SEQ ID NO: 1326

SEQ ID NO: 9798 - DNA, 601 bp, Human; identical to SEQ ID NO: 1177

SEQ ID NO: 9799 - DNA, 601 bp, Human; identical to SEQ ID NO: 1178

SEQ ID NO: 9800 - DNA, 601 bp, Human; identical to SEQ ID NO: 1179

SEQ ID NO: 9801 - DNA, 601 bp, Human; identical to SEQ ID NO: 1180

SEQ ID NO: 9802 - DNA, 601 bp, Human; identical to SEQ ID NO: 1181

SEQ ID NO: 9803 - DNA, 601 bp, Human; identical to SEQ ID NO: 1182

SEQ ID NO: 9804 - DNA, 601 bp, Human; identical to SEQ ID NO: 1183

SEQ ID NO: 9805 - DNA, 553 bp, Human
cacggtcctatcttcagcagcttctttattttctttcttttcttgtttttcttctttatgttttcatttgataaatatttccccccaagattttattgtgaaagttttcggccaggcgtggtggctcacatctgtaatcccagcactttgggaggccaaggctggcagatcacctgaggtcaagagtttgagaccagcctggccaacatggtgaaaccccatctctactaaaaatacaaaaattagccaggcrtggtggcgaacacctgtaatcccagctaccagggaggctagggtgggagaatcgcttgaacctaagaagcagaggttgcagtgagccaagattgcgccagtgcactccagcctgggcaacagagctagactctgtttcaaaaaaaaaaaaaaatgttttcaagatacaataaaagtgaaagaatggtactatgaaggtccatatacccaccatgtaccattttgattctacaattaatgttgggttttattcatcttatcacatctctattcatctgtccatccctctatccatccacac

SEQ ID NO: 9806 - DNA, 601 bp, Human
gggagaatcgcttgaacctaagaagcagaggttgcagtgagccaagattgcgccagtgcactccagcctgggcaacagagctagactctgtttcaaaaaaaaaaaaaaatgttttcaagatacaataaaagtgaaagaatggtactatgaaggtccatatacccaccatgtaccattttgattctacaattaatgttgggttttattcatcttatcacatctctattcatctgtccatccctctatccatccacacacccattcattatatttttggtacatttcaatgtacatttcaaaygtaaattgcagatttacactcccctcgtgtacttcagcatcctttcttttaaggccatgcagtgtttcgttgggtagatgaaccataatttgtttaagcagtcccttgctaagggacacgtgggtttttaatctgttgctgtgagtgcttgatactcactcactgatttctggcatactcctgcaatgtaggaaccaccacccccatttcatagatgtgagatcaaaggttcagagaagctgcattgcaaaggcacacagctaggaagcggttcaaaagcaggttcctttgttttgtttt

SEQ ID NO: 9807 - DNA, 601 bp, Human; identical to SEQ ID NO: 1184

SEQ ID NO: 9808 - DNA, 601 bp, Human; identical to SEQ ID NO: 1185

SEQ ID NO: 9809 - DNA, 601 bp, Human; identical to SEQ ID NO: 1186

SEQ ID NO: 9810 - DNA, 601 bp, Human; identical to SEQ ID NO: 1187

SEQ ID NO: 9811 - DNA, 601 bp, Human; identical to SEQ ID NO: 1188

SEQ ID NO: 9812 - DNA, 601 bp, Human; identical to SEQ ID NO: 1189

SEQ ID NO: 9813 - DNA, 601 bp, Human; identical to SEQ ID NO: 1190

SEQ ID NO: 9814 - DNA, 601 bp, Human; identical to SEQ ID NO: 1191

SEQ ID NO: 9815 - DNA, 601 bp, Human; identical to SEQ ID NO: 1192

SEQ ID NO: 9816 - DNA, 601 bp, Human; identical to SEQ ID NO: 1193

SEQ ID NO: 9817 - DNA, 601 bp, Human; identical to SEQ ID NO: 1194

SEQ ID NO: 9818 - DNA, 601 bp, Human; identical to SEQ ID NO: 1195

SEQ ID NO: 9819 - DNA, 601 bp, Human; identical to SEQ ID NO: 1196

SEQ ID NO: 9820 - DNA, 601 bp, Human; identical to SEQ ID NO: 1197

SEQ ID NO: 9821 - DNA, 601 bp, Human; identical to SEQ ID NO: 1198

SEQ ID NO: 9822 - DNA, 601 bp, Human; identical to SEQ ID NO: 1199

SEQ ID NO: 9823 - DNA, 601 bp, Human
caaagtgctgggactacagtcacgaggcaccgcacccagacagatcttttttttttaagagggggacaacagttgccccaaggaaagcaatccccctggggaatttggggcactggggcagccatcatgggacccatgggtaagggctcagtgacagcagtgcctgctccccctaacattgcctgttctctccaggacgagaagttcctcggaagacacagctggggagctccctgctgttcgggacctaaagaaactggagtttgcgtaagcaaaggggtggattgtcttgtgggtctgygcaaggtttcccctgcagcattagctgggcttgtaccacctgaatggagatagatctccagaatcattcttaccctcttgcccaccactttggaaatagcttccagcagctggaaagtgaccagtgtgggcaaatgctggaggttctcagatttgaagctaatggacccgtttgctggttaacatggtcattcccatcactcattcaacagacgtattgagcacttgaatgactgaggctgctgtcctcatgagctgacagtctaatcaactcccctctggaggaggtcagggggacttc

SEQ ID NO: 9824 - DNA, 601 bp, Human
ttgcctgttctctccaggacgagaagttcctcggaagacacagctggggagctccctgctgttcgggacctaaagaaactggagtttgcgtaagcaaaggggtggattgtcttgtgggtctgcgcaaggtttcccctgcagcattagctgggcttgtaccacctgaatggagatagatctccagaatcattcttaccctcttgcccaccactttggaaatagcttccagcagctggaaagtgaccagtgtgggcaaatgctggaggttctcagatttgaagctaatggacccgtttgctgsttaacatggtcattcccatcactcattcaacagacgtattgagcacttgaatgactgaggctgctgtcctcatgagctgacagtctaatcaactcccctctggaggaggtcagggggacttcctggaggaggtgatatctgcactgaagcttcagtgaggataaggaatgagctgagtggggagaggggagtaagaaaggctttccaggaattgtaatttggccagggatcagaaaaggcccaatgtgtccccaaccttccataggaggatgccactatgactatggagtccttttccct

SEQ ID NO: 9825 - DNA, 601 bp, Human
agacacagctggggagctccctgctgttcgggacctaaagaaactggagtttgcgtaagcaaaggggtggattgtcttgtgggtctgcgcaaggtttcccctgcagcattagctgggcttgtaccacctgaatggagatagatctccagaatcattcttaccctcttgcccaccactttggaaatagcttccagcagctggaaagtgaccagtgtgggcaaatgctggaggttctcagatttgaagctaatggacccgtttgctggttaacatggtcattcccatcactcattcaacagasgtattgagcacttgaatgactgaggctgctgtcctcatgagctgacagtctaatcaactcccctctggaggaggtcagggggacttcctggaggaggtgatatctgcactgaagcttcagtgaggataaggaatgagctgagtggggagaggggagtaagaaaggctttccaggaattgtaatttggccagggatcagaaaaggcccaatgtgtccccaaccttccataggaggatgccactatgactatggagtccttttccctcctgtggccaggaactgcacaacgtcccttgtgcc

SEQ ID NO: 9826 - DNA, 601 bp, Human
aggaggtcagggggacttcctggaggaggtgatatctgcactgaagcttcagtgaggataaggaatgagctgagtggggagaggggagtaagaaaggctttccaggaattgtaatttggccagggatcagaaaaggcccaatgtgtccccaaccttccataggaggatgccactatgactatggagtccttttccctcctgtggccaggaactgcacaacgtcccttgtgcctgagcttgtttacttccacagccaagggatggcctccccagggagaatctttcccccattttgaaattyccaggagcttttgatgtgcagctaggatgaaaaagcaaccctacttgcctgggactatcctggtttgaaaactgaaagtcttgcatcccaagaagcccttagtcccaggcaaactgggacagttggtcgctctatgtgtggccagggctgggggccaacaccctaggcagtgctgctggggtgacagaaatggagacctaggcaaggctctagggagtccagttgtgtctgggtcactgaggaggggcagcccaccatacatgggccccaagaaagcacaataattattatatttagatc

SEQ ID NO: 9827 - DNA, 601 bp, Human
gcttttgatgtgcagctaggatgaaaaagcaaccctacttgcctgggactatcctggtttgaaaactgaaagtcttgcatcccaagaagcccttagtcccaggcaaactgggacagttggtcgctctatgtgtggccagggctgggggccaacaccctaggcagtgctgctggggtgacagaaatggagacctaggcaaggctctagggagtccagttgtgtctgggtcactgaggaggggcagcccaccatacatgggccccaagaaagcacaataattattatatttagatctgtcagwatatagcttttctttctttctttcctttctttctctctttctttttctttctttcttctttctttctttctctctttctttcctctttctttcctttcccttccttttctttccttccctccctccctcccttccttccttccctccctcccttcttcccccttttcttctttttctttctctctgtttctttctttctttctctctctctctcttccttccttcctccctccctatctctctctttctttctttctttccttcttttctttctttcctttctctcctttctctttcttt

SEQ ID NO: 9828 - DNA, 601 bp, Human
acaggcttttaaatttgcagctcaccttccatctcaattatctcaggccaccctcctctacaggcattgtcatcatctccccattgtacaaatggcaatgctgagaacaagagactttaaattgtttatccaaagtcataaaggtcaggtcagcctggccctaagctccttccacagaaaaagctaaatgaatgtttgttccttggtaggggtctagatcatctaatgattaggaaggagttgttatgcctgtggtatattcggtgctgtttttttttggagatggggtcttgctctgtcrcccaggctagaatgcagtggtatgatcttggctcactgcaatctccacctctcggttcaagcaattttcctgcctcagcctcccgagtagctgggattacaggtgtacaccactacacctggctaatttttgtatttttagtagagacgggctttaaccatgttggccaggctggtcttgaactcctggcctcagatgttcctcccacctcagcctcccaaagtgctgggattacaggcgtaagccaccacgcccagcttataattcagtgcattttatatataatctcattaatctcaa

SEQ ID NO: 9829 - DNA, 601 bp, Human
tccccattttacagatgaggagacggaggcctggtgaggttaagtgacttgcccgtggtcccccagctggtcacccacaagctatcagctctccctgatcactgctcccctgtgccccagaaaaaagccagtgtctcttgttttgaacagagacaaggtgctaaatttgtccagaggtaaaaatgatgctgaaaagggggaatgtctgaaaacaataactgagggccctttctggccttaaattattttcagctgaaaaagcccctagttcaagatcggaactgcgctctggggaacagcsgccatggggtggaacagcctagagccgggtgatcagccacctggagaccggaagcccccgaggaggttctgaggaaggaaggaaggaaggaaaagactatttctggcattttctcaggcttctactgtgcccaggcaccctgtagacctcatctgtctgtcaaatcagggttcttagccactcacaaccctacagggacttcgtttgtacacagagtccttccccagttcagtccccactcacctgttcacccttatctcctacactcgctgggtgctctctccattccagccacagggc

SEQ ID NO: 9830 - DNA, 601 bp, Human
cagcacccagaaggcagggattttcgtctgtttggcccacaactttcctccctgggcctggcacatagtaggcaagcggtcaatatttaacaacgaatgccttaatccaagaacccccataagattggggtgaaatatttgaggagatcaagacttaagggtgaagggatttgccaaggcctttagcagggagccaaatgccagatcctggagtcaaactctgatcctgtggccttttgctgaggccagtgttctcagacttcaggatttcagaggccgagaacatttcggaatgaattcragtgaccgtgcgcggttactgttttttaatgtttatcaaggatgctcattcaaacaaacaaataacaacaaaatacccactgctggcaccataattttaccaaagaatgatcattctaatattgaaaaagttcaaaggacataattgcagaataaaagacagctctttatatggaatgcatttaaccatatttttaaactaaacggcccttcgttgtccttatttttctcatccccttgaagtctgctctaaatgttgatccaggctgtgtgaccctgtgtgagctatttgatcgcctag

SEQ ID NO: 9831 - DNA, 601 bp, Human
gattttcgtctgtttggcccacaactttcctccctgggcctggcacatagtaggcaagcggtcaatatttaacaacgaatgccttaatccaagaacccccataagattggggtgaaatatttgaggagatcaagacttaagggtgaagggatttgccaaggcctttagcagggagccaaatgccagatcctggagtcaaactctgatcctgtggccttttgctgaggccagtgttctcagacttcaggatttcagaggccgagaacatttcggaatgaattcaagtgaccgtgcgcggttmctgttttttaatgtttatcaaggatgctcattcaaacaaacaaataacaacaaaatacccactgctggcaccataattttaccaaagaatgatcattctaatattgaaaaagttcaaaggacataattgcagaataaaagacagctctttatatggaatgcatttaaccatatttttaaactaaacggcccttcgttgtccttatttttctcatccccttgaagtctgctctaaatgttgatccaggctgtgtgaccctgtgtgagctatttgatcgcctagtgcctcagtttccctata

SEQ ID NO: 9832 - DNA, 601 bp, Human; identical to SEQ ID NO: 1200

SEQ ID NO: 9833 - DNA, 601 bp, Human; identical to SEQ ID NO: 1201

SEQ ID NO: 9834 - DNA, 601 bp, Human; identical to SEQ ID NO: 1202

SEQ ID NO: 9835 - DNA, 601 bp, Human; identical to SEQ ID NO: 1203

SEQ ID NO: 9836 - DNA, 601 bp, Human; identical to SEQ ID NO: 1204

SEQ ID NO: 9837 - DNA, 601 bp, Human; identical to SEQ ID NO: 1205

SEQ ID NO: 9838 - DNA, 601 bp, Human; identical to SEQ ID NO: 1206

SEQ ID NO: 9839 - DNA, 601 bp, Human; identical to SEQ ID NO: 1207

SEQ ID NO: 9840 - DNA, 601 bp, Human; identical to SEQ ID NO: 1208

SEQ ID NO: 9841 - DNA, 601 bp, Human; identical to SEQ ID NO: 1209

SEQ ID NO: 9842 - DNA, 601 bp, Human; identical to SEQ ID NO: 1210

SEQ ID NO: 9843 - DNA, 601 bp, Human; identical to SEQ ID NO: 1211

SEQ ID NO: 9844 - DNA, 601 bp, Human; identical to SEQ ID NO: 1212

SEQ ID NO: 9845 - DNA, 601 bp, Human; identical to SEQ ID NO: 2575

SEQ ID NO: 9846 - DNA, 601 bp, Human; identical to SEQ ID NO: 2576

SEQ ID NO: 9847 - DNA, 601 bp, Human; identical to SEQ ID NO: 2577

SEQ ID NO: 9848 - DNA, 601 bp, Human; identical to SEQ ID NO: 2578

SEQ ID NO: 9849 - DNA, 601 bp, Human; identical to SEQ ID NO: 2579

SEQ ID NO: 9850 - DNA, 601 bp, Human; identical to SEQ ID NO: 2580

SEQ ID NO: 9851 - DNA, 601 bp, Human; identical to SEQ ID NO: 2581

SEQ ID NO: 9852 - DNA, 601 bp, Human; identical to SEQ ID NO: 2582

SEQ ID NO: 9853 - DNA, 601 bp, Human; identical to SEQ ID NO: 2583

SEQ ID NO: 9854 - DNA, 601 bp, Human; identical to SEQ ID NO: 2584

SEQ ID NO: 9855 - DNA, 601 bp, Human; identical to SEQ ID NO: 2585

SEQ ID NO: 9856 - DNA, 601 bp, Human; identical to SEQ ID NO: 2586

SEQ ID NO: 9857 - DNA, 601 bp, Human; identical to SEQ ID NO: 2587

SEQ ID NO: 9858 - DNA, 601 bp, Human; identical to SEQ ID NO: 2588

SEQ ID NO: 9859 - DNA, 601 bp, Human; identical to SEQ ID NO: 2589

SEQ ID NO: 9860 - DNA, 601 bp, Human; identical to SEQ ID NO: 2590

SEQ ID NO: 9861 - DNA, 601 bp, Human; identical to SEQ ID NO: 2591

SEQ ID NO: 9862 - DNA, 601 bp, Human; identical to SEQ ID NO: 2592

SEQ ID NO: 9863 - DNA, 601 bp, Human; identical to SEQ ID NO: 2593

SEQ ID NO: 9864 - DNA, 601 bp, Human; identical to SEQ ID NO: 2594

SEQ ID NO: 9865 - DNA, 601 bp, Human; identical to SEQ ID NO: 2595

SEQ ID NO: 9866 - DNA, 601 bp, Human; identical to SEQ ID NO: 2596

SEQ ID NO: 9867 - DNA, 601 bp, Human; identical to SEQ ID NO: 2597

SEQ ID NO: 9868 - DNA, 601 bp, Human; identical to SEQ ID NO: 2598

SEQ ID NO: 9869 - DNA, 601 bp, Human; identical to SEQ ID NO: 2599

SEQ ID NO: 9870 - DNA, 601 bp, Human; identical to SEQ ID NO: 2600

SEQ ID NO: 9871 - DNA, 601 bp, Human; identical to SEQ ID NO: 2601

SEQ ID NO: 9872 - DNA, 601 bp, Human; identical to SEQ ID NO: 2602

SEQ ID NO: 9873 - DNA, 601 bp, Human; identical to SEQ ID NO: 2603

SEQ ID NO: 9874 - DNA, 601 bp, Human; identical to SEQ ID NO: 2604

SEQ ID NO: 9875 - DNA, 601 bp, Human; identical to SEQ ID NO: 2605

SEQ ID NO: 9876 - DNA, 601 bp, Human; identical to SEQ ID NO: 2606

SEQ ID NO: 9877 - DNA, 601 bp, Human; identical to SEQ ID NO: 2607

SEQ ID NO: 9878 - DNA, 601 bp, Human; identical to SEQ ID NO: 2608

SEQ ID NO: 9879 - DNA, 601 bp, Human; identical to SEQ ID NO: 2609

SEQ ID NO: 9880 - DNA, 601 bp, Human; identical to SEQ ID NO: 2610

SEQ ID NO: 9881 - DNA, 601 bp, Human; identical to SEQ ID NO: 2611

SEQ ID NO: 9882 - DNA, 601 bp, Human; identical to SEQ ID NO: 2612

SEQ ID NO: 9883 - DNA, 601 bp, Human; identical to SEQ ID NO: 2613

SEQ ID NO: 9884 - DNA, 601 bp, Human; identical to SEQ ID NO: 2614

SEQ ID NO: 9885 - DNA, 601 bp, Human; identical to SEQ ID NO: 2615

SEQ ID NO: 9886 - DNA, 601 bp, Human; identical to SEQ ID NO: 2616

SEQ ID NO: 9887 - DNA, 601 bp, Human; identical to SEQ ID NO: 2617

SEQ ID NO: 9888 - DNA, 601 bp, Human; identical to SEQ ID NO: 2618

SEQ ID NO: 9889 - DNA, 601 bp, Human; identical to SEQ ID NO: 2619

SEQ ID NO: 9890 - DNA, 601 bp, Human; identical to SEQ ID NO: 2620

SEQ ID NO: 9891 - DNA, 601 bp, Human; identical to SEQ ID NO: 2621

SEQ ID NO: 9892 - DNA, 601 bp, Human; identical to SEQ ID NO: 2622

SEQ ID NO: 9893 - DNA, 601 bp, Human; identical to SEQ ID NO: 2623

SEQ ID NO: 9894 - DNA, 601 bp, Human; identical to SEQ ID NO: 2624

SEQ ID NO: 9895 - DNA, 601 bp, Human; identical to SEQ ID NO: 2625

SEQ ID NO: 9896 - DNA, 601 bp, Human; identical to SEQ ID NO: 2626

SEQ ID NO: 9897 - DNA, 601 bp, Human; identical to SEQ ID NO: 2627

SEQ ID NO: 9898 - DNA, 601 bp, Human; identical to SEQ ID NO: 2628

SEQ ID NO: 9899 - DNA, 601 bp, Human; identical to SEQ ID NO: 2629

SEQ ID NO: 9900 - DNA, 601 bp, Human; identical to SEQ ID NO: 2630

SEQ ID NO: 9901 - DNA, 601 bp, Human; identical to SEQ ID NO: 2631

SEQ ID NO: 9902 - DNA, 601 bp, Human; identical to SEQ ID NO: 2632

SEQ ID NO: 9903 - DNA, 601 bp, Human; identical to SEQ ID NO: 2633

SEQ ID NO: 9904 - DNA, 601 bp, Human; identical to SEQ ID NO: 2634

SEQ ID NO: 9905 - DNA, 601 bp, Human; identical to SEQ ID NO: 2635

SEQ ID NO: 9906 - DNA, 601 bp, Human; identical to SEQ ID NO: 2636

SEQ ID NO: 9907 - DNA, 601 bp, Human; identical to SEQ ID NO: 2637

SEQ ID NO: 9908 - DNA, 601 bp, Human; identical to SEQ ID NO: 2638

SEQ ID NO: 9909 - DNA, 601 bp, Human; identical to SEQ ID NO: 2639

SEQ ID NO: 9910 - DNA, 601 bp, Human; identical to SEQ ID NO: 2640

SEQ ID NO: 9911 - DNA, 601 bp, Human; identical to SEQ ID NO: 2641

SEQ ID NO: 9912 - DNA, 601 bp, Human; identical to SEQ ID NO: 2642

SEQ ID NO: 9913 - DNA, 601 bp, Human; identical to SEQ ID NO: 2643

SEQ ID NO: 9914 - DNA, 601 bp, Human; identical to SEQ ID NO: 2644

SEQ ID NO: 9915 - DNA, 601 bp, Human; identical to SEQ ID NO: 2645

SEQ ID NO: 9916 - DNA, 601 bp, Human; identical to SEQ ID NO: 2646

SEQ ID NO: 9917 - DNA, 601 bp, Human; identical to SEQ ID NO: 2647

SEQ ID NO: 9918 - DNA, 601 bp, Human; identical to SEQ ID NO: 2648

SEQ ID NO: 9919 - DNA, 601 bp, Human; identical to SEQ ID NO: 2649

SEQ ID NO: 9920 - DNA, 601 bp, Human; identical to SEQ ID NO: 2650

SEQ ID NO: 9921 - DNA, 601 bp, Human; identical to SEQ ID NO: 2651

SEQ ID NO: 9922 - DNA, 601 bp, Human; identical to SEQ ID NO: 2652

SEQ ID NO: 9923 - DNA, 601 bp, Human; identical to SEQ ID NO: 2653

SEQ ID NO: 9924 - DNA, 601 bp, Human; identical to SEQ ID NO: 2654

SEQ ID NO: 9925 - DNA, 601 bp, Human; identical to SEQ ID NO: 2655

SEQ ID NO: 9926 - DNA, 601 bp, Human; identical to SEQ ID NO: 2656

SEQ ID NO: 9927 - DNA, 601 bp, Human; identical to SEQ ID NO: 2657

SEQ ID NO: 9928 - DNA, 601 bp, Human; identical to SEQ ID NO: 2658

SEQ ID NO: 9929 - DNA, 601 bp, Human; identical to SEQ ID NO: 2659

SEQ ID NO: 9930 - DNA, 601 bp, Human; identical to SEQ ID NO: 2660

SEQ ID NO: 9931 - DNA, 601 bp, Human; identical to SEQ ID NO: 2661

SEQ ID NO: 9932 - DNA, 601 bp, Human; identical to SEQ ID NO: 2662

SEQ ID NO: 9933 - DNA, 601 bp, Human; identical to SEQ ID NO: 1313

SEQ ID NO: 9934 - DNA, 601 bp, Human; identical to SEQ ID NO: 1314

SEQ ID NO: 9935 - DNA, 601 bp, Human; identical to SEQ ID NO: 1315

SEQ ID NO: 9936 - DNA, 601 bp, Human; identical to SEQ ID NO: 1316

SEQ ID NO: 9937 - DNA, 601 bp, Human; identical to SEQ ID NO: 1317

SEQ ID NO: 9938 - DNA, 601 bp, Human; identical to SEQ ID NO: 1318

SEQ ID NO: 9939 - DNA, 601 bp, Human; identical to SEQ ID NO: 1319

SEQ ID NO: 9940 - DNA, 601 bp, Human; identical to SEQ ID NO: 1320

SEQ ID NO: 9941 - DNA, 601 bp, Human
tgaaactttctagaagagtgccattatgcaggtaatcactgtgaggctctggtaacacagtgacccctcagggccggctctgcacattacttattttttgtctgctgaagatttatttatttaggccatatatagttttattttcttttgaaaatacattatcttaaaattcccacatatggttcatgaaaaacagcactgaaaaatatttctaatgtcattttcctcatttatttttctctattgttggtattgaaatataaaatgctgtttttccctgattataaagtattaaactagttttttttttattattattacccaaggatactggactaggaaagttttcaacacatgctgaagaaaattttagaagtgagtttgggaaacttttggaatataaccttcattttttctaaaattaatcttaaaaaaaggatgaggagtgtaaatttcacactgtaccctctagaagcacagtgcaacttgcatccctctttcctgccatcacctccagcctccctcattagaacaagcctccttcattccattatctgcactagaattaaggtactctttcttttctttattttttattcta

SEQ ID NO: 9942 - DNA, 601 bp, Human
tttgggcttgaacgagaggatttacctgttggcaatatctttctgggatgtgtctgtttctacctttttgaaaattagcaatctgtgtctggctttaggcttcctgtcacactcctggccgtctggtttctcaaggaagactactgttaccacagcctaacaagacaagcacttgttaggctgtgcaatgtgatctgtcggaacctcttgtttctttttttttttttttttttcttttttgagatggagtctcgctctgtcacccatgctggagtgcaggggagcgatctcggctcagtgyaacctccatctcccgggttcaagtgattctcctgactcagtctccctagtagctgggattacaggtgcccaccaccatgcccggctaacttttatatttttagtagagacggggtttcaccatgttggccaagctggtgtccaactcctgacctcaagtgatccgccccccttggcctcccaaagtgctggaattacaggcatgagccacctacctggccctgttgggacctcttactccaatctctcaactacttcaggcttcccaccaacttcagtctgaagaacattcttcttgaga

SEQ ID NO: 9943 - DNA, 601 bp, Human
tcaacccctggcaaccactaatctgcttcccatctctataattttgccattttgggaatgttacataaagaaattacacagtatgtgacttctttaagattgatttttttttcacatagtgtaattcctttgaaacccatccaagttgtatccatccatagttggctcttcttattgagtagcattccatgatatgaatatatcaaagattgtttaacattcacccactgaaggacatttgggttgttttcagtttgggggctattacaaataaagttgccatgaccatttctgtaagtgctttgtgtgactttaagttctcatttctccaaggtaaatgtccaaaagtgtaattgctggattctaagtgtgtttggttttacaagaagtagtcgatatattttccagtgtgactataccattttacattcccagcagcaatgtacaactgatccagttttctgcaacctcgtcaacatttgacattatcactatttttaaatgtagccattctcgtagatgtatactgatatttcattgtagatttaatttacattttcctaatggccagtaatgttgactatcttctcatgtgcttaaa

SEQ ID NO: 9944 - DNA, 601 bp, Human
tgacattatcactatttttaaatgtagccattctcgtagatgtatactgatatttcattgtagatttaatttacattttcctaatggccagtaatgttgactatcttctcatgtgcttaaataccatatgtatagcctcttcagtgaaatgtctctttgtgtcttttgcccatgttttaattggatcttttattttttatggtttggttttaagagttctttatatattctatatataagtcctttgctagatatgtggtttgcacatattttctccgagtctgtaacttgcattgttatsttcatatcagcatcttttacaatgcaaaagtttttaattctgacaaggtccaacctaacaatttttccatgtatgtattatgctttcggtgtcaagtctaagagttctttagcccttgttggtgaagattttcttctctatcttattctaaaatttttgtagttttacattatttttatttttatatgttagagacaagatctcactatgttgcccaagttggagtgtgcagtggctattcacaggtgtgatcatagtgcattgcagcctcaaactcatgggctcatgtgatcttcccac

SEQ ID NO: 9945 - DNA, 601 bp, Human
gtagccattctcgtagatgtatactgatatttcattgtagatttaatttacattttcctaatggccagtaatgttgactatcttctcatgtgcttaaataccatatgtatagcctcttcagtgaaatgtctctttgtgtcttttgcccatgttttaattggatcttttattttttatggtttggttttaagagttctttatatattctatatataagtcctttgctagatatgtggtttgcacatattttctccgagtctgtaacttgcattgttatgttcatatcagcatcttttacaaygcaaaagtttttaattctgacaaggtccaacctaacaatttttccatgtatgtattatgctttcggtgtcaagtctaagagttctttagcccttgttggtgaagattttcttctctatcttattctaaaatttttgtagttttacattatttttatttttatatgttagagacaagatctcactatgttgcccaagttggagtgtgcagtggctattcacaggtgtgatcatagtgcattgcagcctcaaactcatgggctcatgtgatcttcccacttcagcctcccaagtagctggga

SEQ ID NO: 9946 - DNA, 601 bp, Human
gtctgtaacttgcattgttatgttcatatcagcatcttttacaatgcaaaagtttttaattctgacaaggtccaacctaacaatttttccatgtatgtattatgctttcggtgtcaagtctaagagttctttagcccttgttggtgaagattttcttctctatcttattctaaaatttttgtagttttacattatttttatttttatatgttagagacaagatctcactatgttgcccaagttggagtgtgcagtggctattcacaggtgtgatcatagtgcattgcagcctcaaactcaygggctcatgtgatcttcccacttcagcctcccaagtagctgggactagaggctcataccaccatgcctgcccgtgatccattttgaattgattctcgtataacgtataatgtgtaggccaaggttttcatatgtttcattttgttgaccatggatacatagtcattccagcaccatttgttgaaaggctatcctttccctgttgaattgcttttacacctttgtcaaaaacaacttgggtaaatttgtgtgcatctcattctgcattctttattctattccagtgatctatgtgactatc

SEQ ID NO: 9947 - DNA, 601 bp, Human
gcaaagcaagaggcttgaagaaagttattcctcaaaagaaaccatcatttccaacactcacaatttattcttcaacaagaaggaaaactttgaagaggaaatttttactttctacaatccctcctcttttactttttagttttcctcttcaaacttgcttaacatgtcttggcttagttgttttgattaactcttggatgtatggtacaacataatacttaagaagaaggagtatacttattatagttgttgaagaggtaagaattgaagctatgtttgtttgtttgtttgtttgtttctkgttgatgaaatactagagtaaaagggataggcaattgaactagagcaaaagtattgctccaattatttggcagagtgtccagtaatggtcctccataataccaccatacatccgctaagggcaggtgtatgaataagggtggactgatgggtcagctcttggaagtgactgacttcactgcatcctgttaagtctccaaggaatgccagatttttccccttgtcattggatatatgaggtaaaattggttttggaagatggaggctggatggccctcgcaggctgatccgcagggtgttg

SEQ ID NO: 9948 - DNA, 601 bp, Human
ttgaagaaagttattcctcaaaagaaaccatcatttccaacactcacaatttattcttcaacaagaaggaaaactttgaagaggaaatttttactttctacaatccctcctcttttactttttagttttcctcttcaaacttgcttaacatgtcttggcttagttgttttgattaactcttggatgtatggtacaacataatacttaagaagaaggagtatacttattatagttgttgaagaggtaagaattgaagctatgtttgtttgtttgtttgtttgtttcttgttgatgaaatacyagagtaaaagggataggcaattgaactagagcaaaagtattgctccaattatttggcagagtgtccagtaatggtcctccataataccaccatacatccgctaagggcaggtgtatgaataagggtggactgatgggtcagctcttggaagtgactgacttcactgcatcctgttaagtctccaaggaatgccagatttttccccttgtcattggatatatgaggtaaaattggttttggaagatggaggctggatggccctcgcaggctgatccgcagggtgttgaacttcaggaaata

SEQ ID NO: 9949 - DNA, 601 bp, Human
ccagggggtggaatcttgaaaaagagctaccatgcactccatgtccccttgatttgaggaccatgctagtggaaaggcaacaacgtgggcctctggcctaccttgcacacaagagtagcagtcacttttgtttaaagtgcaaacagaatatttaatctattttaaccaggcatttacatctttataccctgtttcaatggctatggtttgccataggtctcctatttctactactgagaccttgcttttgtcatttggcatgaggcgagtcatagtttgattttgtaggtttgggaaaggkgcagttgtaggaggtagaggagggagaacaaagtgcaccttaaagaagcctataggatcctttccagtgacttctgctcctaaaccacagaagtgccctacagtggggttagagttgctggtggtaggaatagtaatggatttaagcactgggttaggaaaggaaaggaaaagatagatagactaagctttccttagctttaatttggtagggcttgacccaggaacaatggcccatgattctgaggataatggcacttgcttgactcaggtgtcatgtgtccatccctttccgctgtac

SEQ ID NO: 9950 - DNA, 601 bp, Human
ttacctttatatgagtgtgtcattaatgttaaatttaattttaataaaaccttgttgacatatgtatccaattttaatgtctgaccataaggtaagatttttatagactgtttttaaccttttataattttttgttaaagagcaggttagtgttttaagaaaaacctgttgttcttttattttaatatccagttcacagaaaaactggatgacacccctttaactttagccaatatgtttacacacagaatttcctttacaattaaagtttcaaaacttgcttaaaccttcaaaacaaaatttttttaaccttttaatgtaggtagaaatccacattcttatgcctccttataatccttttaccaaaagtttattttgctttccttacataccttgcatataaactgtttcttcaatagttttacattcaggaggcctaattacttttaagttatacaacatttcttgcataaattcccttttataattttgtttttcacaacttttacagacaattcttcgacatgcctcaactttctgagttgttgctaacatcgctttctttaaacaaccagttaatttattttaggacaagaattta

SEQ ID NO: 9951 - DNA, 601 bp, Human
caggttagtgttttaagaaaaacctgttgttcttttattttaatatccagttcacagaaaaactggatgacacccctttaactttagccaatatgtttacacacagaatttcctttacaattaaagtttcaaaacttgcttaaaccttcaaaacaaaatttttttaaccttttaatgtaggtagaaatccacattcttatgcctccttataatccttttaccaaaagtttattttgctttccttacataccttgcatataaactgtttcttcaatagttttacattcaggaggcctaattwcttttaagttatacaacatttcttgcataaattcccttttataattttgtttttcacaacttttacagacaattcttcgacatgcctcaactttctgagttgttgctaacatcgctttctttaaacaaccagttaatttattttaggacaagaatttaccatataacattcctttttacataaattctcccctcccccctttttttttcctcaaagatgatagccattcttttccaaagtgaacttccttcatgtctgtggactggactgttaaaggccacaagattagaagttaggata

SEQ ID NO: 9952 - DNA, 601 bp, Human
ttcttatgcctccttataatccttttaccaaaagtttattttgctttccttacataccttgcatataaactgtttcttcaatagttttacattcaggaggcctaattacttttaagttatacaacatttcttgcataaattcccttttataattttgtttttcacaacttttacagacaattcttcgacatgcctcaactttctgagttgttgctaacatcgctttctttaaacaaccagttaatttattttaggacaagaatttaccatataacattcctttttacataaattctccccycccccctttttttttcctcaaagatgatagccattcttttccaaagtgaacttccttcatgtctgtggactggactgttaaaggccacaagattagaagttaggataatacatatgacactgttaatatttagcaaattttacttttgttgaaaaccttgtaagtttgggatttcaattatcctttgctattaataagacctaatttagtccaaatttaacttagaattgctatagatgactccttcctgaatctgtaagtattttaaggcttggctgagtgcaaacagctcccaccttt

SEQ ID NO: 9953 - DNA, 601 bp, Human
tcttatgcctccttataatccttttaccaaaagtttattttgctttccttacataccttgcatataaactgtttcttcaatagttttacattcaggaggcctaattacttttaagttatacaacatttcttgcataaattcccttttataattttgtttttcacaacttttacagacaattcttcgacatgcctcaactttctgagttgttgctaacatcgctttctttaaacaaccagttaatttattttaggacaagaatttaccatataacattcctttttacataaattctcccctcccccctttttttttcctcaaagatgatagccattcttttccaaagtgaacttccttcatgtctgtggactggactgttaaaggccacaagattagaagttaggataatacatatgacactgttaatatttagcaaattttacttttgttgaaaaccttgtaagtttgggatttcaattatcctttgctattaataagacctaatttagtccaaatttaacttagaattgctatagatgactccttcctgaatctgtaagtattttaaggcttggctgagtgcaaacagctcccacctttg

SEQ ID NO: 9954 - DNA, 601 bp, Human
cctctgccagccacttatgttgctgctctcccttctccttccccttcccctaggggagcaaccagcaggagtggagcttagcctctttcttacccctttcttacctctttcaggggagttctgaatatttttcttactaccggaggtttgtgtgaggttcaaccacctgaaatttgcagaaggttcaacccctcaaaccagggatgtcttgccttgcctgtcctggaaggctcaacccctcaaaccagtgggtgtcttgccttgcctgccctgggaggttgacctggtttctcccttcccytctctgaaggtcccttgcacacttcccacttgtgttgtcctctctggccgctcccccaagggagaattaggccccttttagtgttggcgtgcaggtataaatcccatggcaggatccgccctaagccatatgaggtagctatggaaccgcagagaggacccactcactccatccagcagtaggacttgtcaccatccacacaaacaacaccgcaagcagggttatctgtgatcattcacgcacatgtacatttagccctccagaatttcatgaccaaggaagtactttaccggctcctgt

SEQ ID NO: 9955 - DNA, 601 bp, Human
gaggtttgtgtgaggttcaaccacctgaaatttgcagaaggttcaacccctcaaaccagggatgtcttgccttgcctgtcctggaaggctcaacccctcaaaccagtgggtgtcttgccttgcctgccctgggaggttgacctggtttctcccttcccctctctgaaggtcccttgcacacttcccacttgtgttgtcctctctggccgctcccccaagggagaattaggccccttttagtgttggcgtgcaggtataaatcccatggcaggatccgccctaagccatatgaggtagctayggaaccgcagagaggacccactcactccatccagcagtaggacttgtcaccatccacacaaacaacaccgcaagcagggttatctgtgatcattcacgcacatgtacatttagccctccagaatttcatgaccaaggaagtactttaccggctcctgtggctttgccttccttggtctgtgcacaaagtcgtcgctgcagtatgtgaggatcctttaagctaggttgctggccagtttctttctgcattgctgagagctcgggttattcctcgcaccaggtgggtcttggtcccttaccc

SEQ ID NO: 9956 - DNA, 601 bp, Human
cagtgggtgtcttgccttgcctgccctgggaggttgacctggtttctcccttcccctctctgaaggtcccttgcacacttcccacttgtgttgtcctctctggccgctcccccaagggagaattaggccccttttagtgttggcgtgcaggtataaatcccatggcaggatccgccctaagccatatgaggtagctatggaaccgcagagaggacccactcactccatccagcagtaggacttgtcaccatccacacaaacaacaccgcaagcagggttatctgtgatcattcacgcacaygtacatttagccctccagaatttcatgaccaaggaagtactttaccggctcctgtggctttgccttccttggtctgtgcacaaagtcgtcgctgcagtatgtgaggatcctttaagctaggttgctggccagtttctttctgcattgctgagagctcgggttattcctcgcaccaggtgggtcttggtcccttacccctgaggccaccgcaagaggtggtgtggtgcctcctcatgaaagaggactagagatgcccccggaggagaatgtatccccatacgattgccaccaaaattgtta

SEQ ID NO: 9957 - DNA, 601 bp, Human
tccgccctaagccatatgaggtagctatggaaccgcagagaggacccactcactccatccagcagtaggacttgtcaccatccacacaaacaacaccgcaagcagggttatctgtgatcattcacgcacatgtacatttagccctccagaatttcatgaccaaggaagtactttaccggctcctgtggctttgccttccttggtctgtgcacaaagtcgtcgctgcagtatgtgaggatcctttaagctaggttgctggccagtttctttctgcattgctgagagctcgggttattcctcrcaccaggtgggtcttggtcccttacccctgaggccaccgcaagaggtggtgtggtgcctcctcatgaaagaggactagagatgcccccggaggagaatgtatccccatacgattgccaccaaaattgttagaaatatcaaaattgttagaaatacatcattggtgccacaaaggaaagtcagcacagagacaaaagatctctcagcaaggccatctttactttctgcagaaagggtgctcaattgcagatggaacaatggcaggagaacacttgaacaaaggaaaagcagacatatttat

SEQ ID NO: 9958 - DNA, 601 bp, Human
tgcagacttcacaggcaggagaagatctaaagcccttgtctttggcagctgggaggcagagaaagcctcaggcaagttttcaaggctgtctccccctccccctggaaacacacttggggctgttgctgggggcacagtgggagtaagactggccctttggtttgtgtgggagctgggtgaggcctgtgactgccagctttcccccacttccctgacaacctgcatgactcagcagaggcagccataatccttctaggtacacaactccagtgacctgggaatctcacccctatcccccacrgcagctgcagcaagacctgccgaaggagactctgagatcatacatgcctagtcccacccctggacctgatggtccttccctacctgccctggtggcagaagacaaaagacatgtgatattgggagttctagggccacacccactgccagtccccctccacactactacagctgatgctttctggaaattgctacctcctggcaggccaaccagcacaaaaatagagcattaaaccaccaaagctaaggaccctcacagagtccactgcaccctctgctgcgtccgctggaacaggtgctg

SEQ ID NO: 9959 - DNA, 601 bp, Human
acacacttggggctgttgctgggggcacagtgggagtaagactggccctttggtttgtgtgggagctgggtgaggcctgtgactgccagctttcccccacttccctgacaacctgcatgactcagcagaggcagccataatccttctaggtacacaactccagtgacctgggaatctcacccctatcccccacggcagctgcagcaagacctgccgaaggagactctgagatcatacatgcctagtcccacccctggacctgatggtccttccctacctgccctggtggcagaagacaaargacatgtgatattgggagttctagggccacacccactgccagtccccctccacactactacagctgatgctttctggaaattgctacctcctggcaggccaaccagcacaaaaatagagcattaaaccaccaaagctaaggaccctcacagagtccactgcaccctctgctgcgtccgctggaacaggtgctggtatccacagctaagaggccgttagttggttcacatgagaggactttgtgcagacaacccccagtaccagcctggagctgggtaaagttgctgggtgactagaccca

SEQ ID NO: 9960 - DNA, 601 bp, Human
cgaaggagactctgagatcatacatgcctagtcccacccctggacctgatggtccttccctacctgccctggtggcagaagacaaaagacatgtgatattgggagttctagggccacacccactgccagtccccctccacactactacagctgatgctttctggaaattgctacctcctggcaggccaaccagcacaaaaatagagcattaaaccaccaaagctaaggaccctcacagagtccactgcaccctctgctgcgtccgctggaacaggtgctggtatccacagctaagaggccsttagttggttcacatgagaggactttgtgcagacaacccccagtaccagcctggagctgggtaaagttgctgggtgactagacccagaagagagacaaaaatcactgcagtttgactcacaggaagccacatccacaggaaaacaggaagaatactacatcaagggaacaccccgtgggacaaaaaaatctgaacagcaatcttcagccctagacttccctctaacagaacctacccaaatgagaaggaactagaaaaccaaccctggtaatatgacgaaacaaggctcatcaacaccac

SEQ ID NO: 9961 - DNA, 601 bp, Human
atcatacatgcctagtcccacccctggacctgatggtccttccctacctgccctggtggcagaagacaaaagacatgtgatattgggagttctagggccacacccactgccagtccccctccacactactacagctgatgctttctggaaattgctacctcctggcaggccaaccagcacaaaaatagagcattaaaccaccaaagctaaggaccctcacagagtccactgcaccctctgctgcgtccgctggaacaggtgctggtatccacagctaagaggccgttagttggttcacatsagaggactttgtgcagacaacccccagtaccagcctggagctgggtaaagttgctgggtgactagacccagaagagagacaaaaatcactgcagtttgactcacaggaagccacatccacaggaaaacaggaagaatactacatcaagggaacaccccgtgggacaaaaaaatctgaacagcaatcttcagccctagacttccctctaacagaacctacccaaatgagaaggaactagaaaaccaaccctggtaatatgacgaaacaaggctcatcaacaccacaccctcaacccccgcc

SEQ ID NO: 9962 - DNA, 601 bp, Human
agctgatgctttctggaaattgctacctcctggcaggccaaccagcacaaaaatagagcattaaaccaccaaagctaaggaccctcacagagtccactgcaccctctgctgcgtccgctggaacaggtgctggtatccacagctaagaggccgttagttggttcacatgagaggactttgtgcagacaacccccagtaccagcctggagctgggtaaagttgctgggtgactagacccagaagagagacaaaaatcactgcagtttgactcacaggaagccacatccacaggaaaacaggragaatactacatcaagggaacaccccgtgggacaaaaaaatctgaacagcaatcttcagccctagacttccctctaacagaacctacccaaatgagaaggaactagaaaaccaaccctggtaatatgacgaaacaaggctcatcaacaccacaccctcaacccccgccctgccaaaaatagaaaaaaaaaaaatcacactagttcaccagcaatggatccaagccaagaagaaatccctgatttacctgaaaaaaaattcaggaggttagttattaagttaatcagggagggaccaggga

SEQ ID NO: 9963 - DNA, 601 bp, Human
agaagaaagaaatgcagagctcaaagacaaggtctttgaattaacccaatccaacaaagacaaagaaaaaagagtaaaaaaatatgaacaaacctccaagaagtctggaattatggtaaacaaccacacctaagaataattgatgttcctgaggaaaaagacaattgtaaaagcttggaaaacatacttgggggaataatcaaggaaaactttcctggccttcccagagacttagacatggaaacacaagaagcacaaagaagacctgggaaattcgttgcaaaaagatcttcccctagayacattgtcatcaggttatctaaagttaagatgaaggaaagagtcttaagagctgtgagacagaagcacaaggtaacctataaaggaaaacctatcagattaacagcagatttctcagcagaaaccctacaagctagaagggattggggccctatcttctgcctcctcaagcaaaacaattatcagccaagaattttgtatccagcaaaactaagcatcatatatgaaggaaagacacagtcattttctgccaagcaaatgctgagataattcaccatggccaagccaccacaacaagaac

SEQ ID NO: 9964 - DNA, 601 bp, Human
aagagtaaaaaaatatgaacaaacctccaagaagtctggaattatggtaaacaaccacacctaagaataattgatgttcctgaggaaaaagacaattgtaaaagcttggaaaacatacttgggggaataatcaaggaaaactttcctggccttcccagagacttagacatggaaacacaagaagcacaaagaagacctgggaaattcgttgcaaaaagatcttcccctagacacattgtcatcaggttatctaaagttaagatgaaggaaagagtcttaagagctgtgagacagaagcacmaggtaacctataaaggaaaacctatcagattaacagcagatttctcagcagaaaccctacaagctagaagggattggggccctatcttctgcctcctcaagcaaaacaattatcagccaagaattttgtatccagcaaaactaagcatcatatatgaaggaaagacacagtcattttctgccaagcaaatgctgagataattcaccatggccaagccaccacaacaagaactgctaaaaacttgaactgtttaaatctgtttaaatcttgaaacaaatcccagaaatacatcaaaacaga

SEQ ID NO: 9965 - DNA, 601 bp, Human
tcccctagacacattgtcatcaggttatctaaagttaagatgaaggaaagagtcttaagagctgtgagacagaagcacaaggtaacctataaaggaaaacctatcagattaacagcagatttctcagcagaaaccctacaagctagaagggattggggccctatcttctgcctcctcaagcaaaacaattatcagccaagaattttgtatccagcaaaactaagcatcatatatgaaggaaagacacagtcattttctgccaagcaaatgctgagataattcaccatggccaagccaccayaacaagaactgctaaaaacttgaactgtttaaatctgtttaaatcttgaaacaaatcccagaaatacatcaaaacagaatctctttaagtcatatatcacacaggacctataaaacaaaaatataagttaaaaagcaaaatcaaaaaaccaaaatgaaacaaagtacaggcaacaaaaagcatgatgaatgcaatggtacctcacatttcaatactagcattaaatataaatggcctaaatgctccacttaaaagatacagaactgcagaatggataagaactcaacaaccaactacctg

SEQ ID NO: 9966 - DNA, 601 bp, Human
ccagtataaaaaatagcacatagaccaatggaaaagaacagagaacccagaaataaacccaaatacttaaagcaaacaaaaatataaagtggggaaaggacacccttttcaacaaatggtgctgggataattggctagccacatataggagaatgaaacttgatcctcctctctcaccttgtacaaaaatcaactcaagatggattaaggacttaaaccaaagacctgaaactgtaaacattatagaagataacattgggaaaacccttctagacattggcttaagcaaagatttcatgamcaagaacccaaaagtaaatgcaataaaaacaaagataaatagctgggacctaattaaactaaagagcttttgcacggcaaaaggaacagtcagcagagtaaacagacaacccacagagtgggagaaaatcttcacaaatctatacatcggacaaaggattaatgtccagaatctacaacaaactcaaacaaatcagtaagaaaaaaaattccatcaaaaagtgggctaaggatatgaaaaaacaattctcaaaagaagatgtacaaatggccaagtgacatgtgaaaaaatgctcaacat

SEQ ID NO: 9967 - DNA, 601 bp, Human
acagtgtgatactaccttactcctgcaagaatggccataataaaaaaaatcaaaaaaaccacagatgttggcatggatgtggtgatcagggaacacttctacactgctggtaggaatgtaaactaggacagctgctatggaaaacagtgtggagattccttaaagaagtaaaagtagaaataccatttgatccagcaatcctactactgggtatctacccagaggaaaagaagtcactgtttgaaaaagatacttgcacatgcatgtttatagcagcacaattcacaattgcaaaatcatrgaaccccaacaagtggataaagaaactgtggtgtatatatgatggaatactactcagccataaaaaggaatgaattaacagcattttcagtgacctggatgagattggagactattattctaagtgaagtaactcaggaatggaaaacgaaacatcatatgttatcactgatatgagggagctaagccatgaaggcataagaatgatatagtggactttggggacttggagggaagagtgggagggtggtgacggataaaagactacaaatacagggcaatgtatactgcttgggtgatg

SEQ ID NO: 9968 - DNA, 601 bp, Human
agactacaaatacagggcaatgtatactgcttgggtgatgggtgcaccaaaatctcacatatcaccactaaacaacttcctcatgtaaccaaatacaacctataccccaataacttatggaaaaataaaataaaataataataataataataaataaaaataaaactttttttgtagattttgtggaatggtttatgtagatggtcatgtactctacaaataagaacattttaatttctttctttccaaactgtatgccttttatttctttttcttgccttactgctctggctagaacttyccagtgctatgttgaataagaaggcaagaacatatatccttgccttgtttcgaatcttaagggaaaagtgtcctgtctttcaccattaagtatgatgttagctttagatagtttgtagatgcagttttttaagttgaggaagttctcctctatttctagtttgctaagaatttttattgtgagtttattatttgttatgagtcatagttttgaattataatgatgagagttttactatgaattggattttggcaagtgctttttctgcactaattttatggtttttcttctttagcttgc

SEQ ID NO: 9969 - DNA, 601 bp, Human
atataattttttaaatatattgcttgatattatttactaacttttttatgcaagttttttttgaaatttttatttctattttaagttccagagtacatgtgcagaatgtgcaggtttgttacacaggtaaatgtatgccatggtggtttgctgcacccgtcaacccatcacctagatattaagctcagaatgcatgagctattattcctaatgctctccctatacccccaccccctgactggccccagtgtgtgttgttcccctccttgtgtccacgtgttctcattgttcagctcccacwtataagtgagaacatgcagtgtttggttttctgttcctacattagttttctgaggataatggcttccagctccatccatgtcactgcaaaggacacgatctcattccttttcatggctgcacagtattccctggagtaaatgtaccacattttctttatccagtctatcattgatggacgtttgggttgattccatgtctttgttattgtgaagagtgctgcaatgaacatacatgtgccatatatctttataatagaatggtttgtaataggattgctgggtcaaatggtatttctggt

SEQ ID NO: 9970 - DNA, 601 bp, Human
tcattctttaaagttagttctgccagtaaaagattctcttcatttctcttcctctgagagtgtctttatttcttgtccattcccacagtgtatttttattggcaatataattcctggttgacaattcttctttttcagaacacaaaataagctgtaccacttacatctgttctccatagtttctgatgagaaactttctgtcattcaaattggtattcctggccaggcacagtggctcatgcctgtaatcccagcattttgggaggctgaggtgggcggatctcttgaggtcaggaattcragaccagcctggacatcatagtgaaaccctgtctctactaaaaatataaaaattagccgggcatggtggcgtgcacctgtaatcacaactacttgggaggctgaggcacaagaatcacctgaacccaggagatggaggttgaagcgagcagagatcatgccagtacactccagcctgggcgacagagtgagataccatctcaaaaaaaaaaaaaaaagtattcctttataagtaatgtgccatttgtctctggctgctttctagatttttcctttttccttagatgtttaattttctctg

SEQ ID NO: 9971 - DNA, 601 bp, Human
cctggccaggcacagtggctcatgcctgtaatcccagcattttgggaggctgaggtgggcggatctcttgaggtcaggaattcaagaccagcctggacatcatagtgaaaccctgtctctactaaaaatataaaaattagccgggcatggtggcgtgcacctgtaatcacaactacttgggaggctgaggcacaagaatcacctgaacccaggagatggaggttgaagcgagcagagatcatgccagtacactccagcctgggcgacagagtgagataccatctcaaaaaaaaaaaaaaaagtattcctttataagtaatgtgccatttgtctctggctgctttctagatttttcctttttccttagatgtttaattttctctgcctttttatgttttcaatgttttagttatgatgtgtcttgatatggatttctttgagtttatcatgtttgcgattttggcagtttctttaatctgtaggtttagatcttccacgaaattagggaaatttttagccattatttctttgaatattttttaagcctcacactttttctaggaattaaatgatatgaattgtaggtgttttgttactggcc

SEQ ID NO: 9972 - DNA, 601 bp, Human
attcagctcatctaccaagtcttttttctttcattggtatttttttagttctatagtttccatttggttctttttttatatgttgtactattttggtgagcttttaaaaaatttgtttcaagaatagttttaattgctcactaaggcattttgttacagctgctttaaaattcttgtggaatagttttaacatctgtgtcatctcaatgctggtatctcttgattgtctcctctcatctgagttgtgattttctctattctttgtatgatgggtgattttccattatataatggatgtttygtatagtatgttaggagattctgagtcctatttaaaacttctattttagtagacagtcacagagtcacacagtttaggtttattatgtaggttctggcctacttgtgtgggctatggtacaatgacaatttagttttcagagccctgtccacgttattttgatccactttgtttacctggtgccattagttcttgctggtcccctgctggtccttcctgcaaggcagaaggcacgttccagtactgcctggtgctatcaggtaggaagtgagatacatcaggcccaaagggaagacatta

SEQ ID NO: 9973 - DNA, 601 bp, Human
ttccaccacgctctgaccatatggtttcaaaatatctgtattttccatgcttgctccagcctctgacttctgtaatacctgtgtctctgaagcacaatttacctttccattcccatgatgtttgtttcataaaatttagtgctgtccaaaaacagtgctgtccatgacactgtatttgccaatttgccatccaccacctcgtgttaaatgtgaggctcccctcgtgtgttatttgtcttcatcatgacggttgcatgaatacctgaggccctgagttgcattcctgatgttctttcaacamttctaactctgcacatgttcagcacccaaacctctgtagccactcattcattcatctattcagtcatcatcttcccagcatgttgtgtgccagataccacgttggtgctggaatacagctcaaagagcttccaggccatttggggagacagagacaaaaacacaatccagggtgatcagtgctatggcagagagaaacagagtgatgtgggagagccaaggggggttccacccagcccagaggaaccagagaaggtgtcctgaagcaggacgggctctactgaacttccgaaggatgagc

SEQ ID NO: 9974 - DNA, 601 bp, Human
ccatttggggagacagagacaaaaacacaatccagggtgatcagtgctatggcagagagaaacagagtgatgtgggagagccaaggggggttccacccagcccagaggaaccagagaaggtgtcctgaagcaggacgggctctactgaacttccgaaggatgagcagaaattagtcttgtgaaagggaaggaggagagccagtattcaggggacacacattgccccaagtcagaagaatgccaccagttgtcatctggcctggccattggtcaggatccatgtggaggtgtgacatggaaytgcagccataggagagctggccagacgggcttcaggtgccaggttgggagcagtgagcccccactgaagggctgagagcagggaatgacttgggcaggttatgtgttgtggggctcactcaggctgctgtgtgagcctggattctggggggtagggtgcagaggagacggggcactccatgctaaactgagtataatcgagtaccactagctaaacaaccaacccaccaacaaaaccactcctctctgtgctgccagagctacccctagaccattgttcatctgggcatttctcaagcag

SEQ ID NO: 9975 - DNA, 601 bp, Human
aagggaaggaggagagccagtattcaggggacacacattgccccaagtcagaagaatgccaccagttgtcatctggcctggccattggtcaggatccatgtggaggtgtgacatggaactgcagccataggagagctggccagacgggcttcaggtgccaggttgggagcagtgagcccccactgaagggctgagagcagggaatgacttgggcaggttatgtgttgtggggctcactcaggctgctgtgtgagcctggattctggggggtagggtgcagaggagacggggcactccatgytaaactgagtataatcgagtaccactagctaaacaaccaacccaccaacaaaaccactcctctctgtgctgccagagctacccctagaccattgttcatctgggcatttctcaagcaggggtccctgctgtgcgggggttggaaggaatatcagcagggtaaacacaggagctgcaggtgataggaaaagatctgaggtttaagtgcatctgtcacaatagttaaaactcacctgcccctatcacaaaagcaaacatggttgggcacacattcccttgggctccttcattattgtctgtt

SEQ ID NO: 9976 - DNA, 601 bp, Human
gggctcactcaggctgctgtgtgagcctggattctggggggtagggtgcagaggagacggggcactccatgctaaactgagtataatcgagtaccactagctaaacaaccaacccaccaacaaaaccactcctctctgtgctgccagagctacccctagaccattgttcatctgggcatttctcaagcaggggtccctgctgtgcgggggttggaaggaatatcagcagggtaaacacaggagctgcaggtgataggaaaagatctgaggtttaagtgcatctgtcacaatagttaaaacycacctgcccctatcacaaaagcaaacatggttgggcacacattcccttgggctccttcattattgtctgtttccctttcagatgtgcccttggggcccatttcaactggatctttcctaggggcagtggtcagtgcaggctagtgaggcaagctcaggccttgaagctagaccaacctggggtcatatgcctgctgtgtcacctgccaccttaactttttaaccccagctctctcctctgtaaaggagtgtaaccatgcctaccttgcagggttgctgcaatggttagagatgatgttgg

SEQ ID NO: 9977 - DNA, 601 bp, Human
aggtttaagtgcatctgtcacaatagttaaaactcacctgcccctatcacaaaagcaaacatggttgggcacacattcccttgggctccttcattattgtctgtttccctttcagatgtgcccttggggcccatttcaactggatctttcctaggggcagtggtcagtgcaggctagtgaggcaagctcaggccttgaagctagaccaacctggggtcatatgcctgctgtgtcacctgccaccttaactttttaaccccagctctctcctctgtaaaggagtgtaaccatgcctaccttkcagggttgctgcaatggttagagatgatgttggtaaatgcctggtgtggaataggtgctcatttaatgtgagcagtaggaactgcagggccttctgcagtctggggccctccctttaatacccctaaacaagacagagtaacagctgacgaaagactagagtcaggacttccaggcaagaaatattacagcctcttttgtaatgtcgcaaactggaaacagctcattaaaagggaaatgttagcatgaactgtggcttttgtctctaaggagtattaggcagctaatctctctctacaaa

SEQ ID NO: 9978 - DNA, 601 bp, Human
ttaaacacattaattcataatttattccacaaacagagattgagaacccaacagggccaggcaccatgctggggcttcaccagtgaacaaggttgatatgacaccttttccagcaaatgatatatggcacagatgtttatttgcccagccacacagatgagtgaccaacagtggcaatttttgctttgtggcaagaaagaggattgggggatgatttgggagtcatgagcttttggtgtctttcccagctgacctcacagggtgccccctgctcacatggagtagggcctggagcaggcarggacttcctgtgctgtgttctctgcagcagcctccttcctcctggcttgtgtttcagttccaaagcccaagaggagaaatggggtgaacttctccctagctgtggtggtcatctacctgatcctgctcaccgctggcgctgggctgctggtggtccaaggtaaagcaggcttggtcctgtgtagtccctcctggggggagaggggtgacccagctgggcccctcagatgaagggctcaggttgagtggagagcctcgggccactgctcccatctgctgggagacagtctcagcccctggc

SEQ ID NO: 9979 - DNA, 601 bp, Human; identical to SEQ ID NO: 3438

SEQ ID NO: 9980 - DNA, 601 bp, Human; identical to SEQ ID NO: 3439

SEQ ID NO: 9981 - DNA, 601 bp, Human; identical to SEQ ID NO: 3440

SEQ ID NO: 9982 - DNA, 601 bp, Human; identical to SEQ ID NO: 3441

SEQ ID NO: 9983 - DNA, 601 bp, Human; identical to SEQ ID NO: 3442

SEQ ID NO: 9984 - DNA, 601 bp, Human; identical to SEQ ID NO: 3443

SEQ ID NO: 9985 - DNA, 601 bp, Human; identical to SEQ ID NO: 3444

SEQ ID NO: 9986 - DNA, 601 bp, Human; identical to SEQ ID NO: 3445

SEQ ID NO: 9987 - DNA, 601 bp, Human; identical to SEQ ID NO: 3446

SEQ ID NO: 9988 - DNA, 601 bp, Human; identical to SEQ ID NO: 3447

SEQ ID NO: 9989 - DNA, 601 bp, Human; identical to SEQ ID NO: 3448

SEQ ID NO: 9990 - DNA, 601 bp, Human; identical to SEQ ID NO: 3449

SEQ ID NO: 9991 - DNA, 601 bp, Human; identical to SEQ ID NO: 3450

SEQ ID NO: 9992 - DNA, 601 bp, Human; identical to SEQ ID NO: 3451

SEQ ID NO: 9993 - DNA, 601 bp, Human; identical to SEQ ID NO: 3452

SEQ ID NO: 9994 - DNA, 601 bp, Human; identical to SEQ ID NO: 3453

SEQ ID NO: 9995 - DNA, 601 bp, Human; identical to SEQ ID NO: 3454

SEQ ID NO: 9996 - DNA, 601 bp, Human; identical to SEQ ID NO: 3455

SEQ ID NO: 9997 - DNA, 601 bp, Human; identical to SEQ ID NO: 3456

SEQ ID NO: 9998 - DNA, 601 bp, Human; identical to SEQ ID NO: 3457

SEQ ID NO: 9999 - DNA, 601 bp, Human; identical to SEQ ID NO: 3458

SEQ ID NO: 10000 - DNA, 601 bp, Human; identical to SEQ ID NO: 3459

SEQ ID NO: 10001 - DNA, 601 bp, Human; identical to SEQ ID NO: 3460

SEQ ID NO: 10002 - DNA, 601 bp, Human; identical to SEQ ID NO: 3461

SEQ ID NO: 10003 - DNA, 601 bp, Human; identical to SEQ ID NO: 3462

SEQ ID NO: 10004 - DNA, 601 bp, Human; identical to SEQ ID NO: 3463

SEQ ID NO: 10005 - DNA, 601 bp, Human; identical to SEQ ID NO: 3464

SEQ ID NO: 10006 - DNA, 601 bp, Human; identical to SEQ ID NO: 3465

SEQ ID NO: 10007 - DNA, 601 bp, Human; identical to SEQ ID NO: 3466

SEQ ID NO: 10008 - DNA, 601 bp, Human; identical to SEQ ID NO: 3467

SEQ ID NO: 10009 - DNA, 601 bp, Human; identical to SEQ ID NO: 3468

SEQ ID NO: 10010 - DNA, 601 bp, Human; identical to SEQ ID NO: 3469

SEQ ID NO: 10011 - DNA, 601 bp, Human; identical to SEQ ID NO: 1521

SEQ ID NO: 10012 - DNA, 601 bp, Human; identical to SEQ ID NO: 1522

SEQ ID NO: 10013 - DNA, 601 bp, Human; identical to SEQ ID NO: 3560

SEQ ID NO: 10014 - DNA, 601 bp, Human; identical to SEQ ID NO: 5950

SEQ ID NO: 10015 - DNA, 601 bp, Human; identical to SEQ ID NO: 5951

SEQ ID NO: 10016 - DNA, 601 bp, Human; identical to SEQ ID NO: 5952

SEQ ID NO: 10017 - DNA, 601 bp, Human; identical to SEQ ID NO: 5953

SEQ ID NO: 10018 - DNA, 601 bp, Human; identical to SEQ ID NO: 5954

SEQ ID NO: 10019 - DNA, 601 bp, Human; identical to SEQ ID NO: 5955

SEQ ID NO: 10020 - DNA, 601 bp, Human; identical to SEQ ID NO: 5956

SEQ ID NO: 10021 - DNA, 601 bp, Human; identical to SEQ ID NO: 5957

SEQ ID NO: 10022 - DNA, 601 bp, Human; identical to SEQ ID NO: 5958

SEQ ID NO: 10023 - DNA, 601 bp, Human; identical to SEQ ID NO: 5959

SEQ ID NO: 10024 - DNA, 601 bp, Human; identical to SEQ ID NO: 5960

SEQ ID NO: 10025 - DNA, 601 bp, Human; identical to SEQ ID NO: 5961

SEQ ID NO: 10026 - DNA, 601 bp, Human; identical to SEQ ID NO: 5962

SEQ ID NO: 10027 - DNA, 601 bp, Human; identical to SEQ ID NO: 5963

SEQ ID NO: 10028 - DNA, 601 bp, Human; identical to SEQ ID NO: 5964

SEQ ID NO: 10029 - DNA, 601 bp, Human; identical to SEQ ID NO: 5965

SEQ ID NO: 10030 - DNA, 601 bp, Human; identical to SEQ ID NO: 5966

SEQ ID NO: 10031 - DNA, 601 bp, Human; identical to SEQ ID NO: 5967

SEQ ID NO: 10032 - DNA, 601 bp, Human; identical to SEQ ID NO: 5968

SEQ ID NO: 10033 - DNA, 601 bp, Human; identical to SEQ ID NO: 5969

SEQ ID NO: 10034 - DNA, 601 bp, Human; identical to SEQ ID NO: 5970

SEQ ID NO: 10035 - DNA, 601 bp, Human; identical to SEQ ID NO: 5971

SEQ ID NO: 10036 - DNA, 601 bp, Human; identical to SEQ ID NO: 5972

SEQ ID NO: 10037 - DNA, 601 bp, Human; identical to SEQ ID NO: 5973

SEQ ID NO: 10038 - DNA, 601 bp, Human; identical to SEQ ID NO: 5974

SEQ ID NO: 10039 - DNA, 601 bp, Human; identical to SEQ ID NO: 5975

SEQ ID NO: 10040 - DNA, 601 bp, Human; identical to SEQ ID NO: 5976

SEQ ID NO: 10041 - DNA, 601 bp, Human; identical to SEQ ID NO: 5977

SEQ ID NO: 10042 - DNA, 601 bp, Human; identical to SEQ ID NO: 5978

SEQ ID NO: 10043 - DNA, 601 bp, Human; identical to SEQ ID NO: 5979

SEQ ID NO: 10044 - DNA, 601 bp, Human; identical to SEQ ID NO: 5980

SEQ ID NO: 10045 - DNA, 601 bp, Human; identical to SEQ ID NO: 5981

SEQ ID NO: 10046 - DNA, 601 bp, Human; identical to SEQ ID NO: 5982

SEQ ID NO: 10047 - DNA, 601 bp, Human; identical to SEQ ID NO: 5983

SEQ ID NO: 10048 - DNA, 601 bp, Human; identical to SEQ ID NO: 5984

SEQ ID NO: 10049 - DNA, 601 bp, Human; identical to SEQ ID NO: 5985

SEQ ID NO: 10050 - DNA, 601 bp, Human; identical to SEQ ID NO: 5986

SEQ ID NO: 10051 - DNA, 601 bp, Human; identical to SEQ ID NO: 5987

SEQ ID NO: 10052 - DNA, 601 bp, Human; identical to SEQ ID NO: 5988

SEQ ID NO: 10053 - DNA, 601 bp, Human; identical to SEQ ID NO: 5989

SEQ ID NO: 10054 - DNA, 601 bp, Human; identical to SEQ ID NO: 5990

SEQ ID NO: 10055 - DNA, 601 bp, Human; identical to SEQ ID NO: 5991

SEQ ID NO: 10056 - DNA, 601 bp, Human; identical to SEQ ID NO: 5992

SEQ ID NO: 10057 - DNA, 601 bp, Human; identical to SEQ ID NO: 5993

SEQ ID NO: 10058 - DNA, 601 bp, Human; identical to SEQ ID NO: 5994

SEQ ID NO: 10059 - DNA, 601 bp, Human; identical to SEQ ID NO: 5995

SEQ ID NO: 10060 - DNA, 601 bp, Human; identical to SEQ ID NO: 5996

SEQ ID NO: 10061 - DNA, 601 bp, Human; identical to SEQ ID NO: 5997

SEQ ID NO: 10062 - DNA, 601 bp, Human; identical to SEQ ID NO: 5998

SEQ ID NO: 10063 - DNA, 601 bp, Human; identical to SEQ ID NO: 5999

SEQ ID NO: 10064 - DNA, 601 bp, Human; identical to SEQ ID NO: 6000

SEQ ID NO: 10065 - DNA, 601 bp, Human; identical to SEQ ID NO: 6001

SEQ ID NO: 10066 - DNA, 601 bp, Human; identical to SEQ ID NO: 6002

SEQ ID NO: 10067 - DNA, 601 bp, Human; identical to SEQ ID NO: 6003

SEQ ID NO: 10068 - DNA, 601 bp, Human; identical to SEQ ID NO: 6004

SEQ ID NO: 10069 - DNA, 601 bp, Human; identical to SEQ ID NO: 6005

SEQ ID NO: 10070 - DNA, 601 bp, Human; identical to SEQ ID NO: 6006

SEQ ID NO: 10071 - DNA, 601 bp, Human; identical to SEQ ID NO: 6007

SEQ ID NO: 10072 - DNA, 601 bp, Human; identical to SEQ ID NO: 6008

SEQ ID NO: 10073 - DNA, 601 bp, Human; identical to SEQ ID NO: 6009

SEQ ID NO: 10074 - DNA, 601 bp, Human; identical to SEQ ID NO: 6010

SEQ ID NO: 10075 - DNA, 601 bp, Human; identical to SEQ ID NO: 6011

SEQ ID NO: 10076 - DNA, 601 bp, Human; identical to SEQ ID NO: 6012

SEQ ID NO: 10077 - DNA, 601 bp, Human; identical to SEQ ID NO: 6013

SEQ ID NO: 10078 - DNA, 601 bp, Human; identical to SEQ ID NO: 6014

SEQ ID NO: 10079 - DNA, 601 bp, Human; identical to SEQ ID NO: 6015

SEQ ID NO: 10080 - DNA, 601 bp, Human; identical to SEQ ID NO: 6016

SEQ ID NO: 10081 - DNA, 601 bp, Human; identical to SEQ ID NO: 6017

SEQ ID NO: 10082 - DNA, 601 bp, Human; identical to SEQ ID NO: 6018

SEQ ID NO: 10083 - DNA, 601 bp, Human; identical to SEQ ID NO: 6019

SEQ ID NO: 10084 - DNA, 601 bp, Human; identical to SEQ ID NO: 6020

SEQ ID NO: 10085 - DNA, 601 bp, Human; identical to SEQ ID NO: 6021

SEQ ID NO: 10086 - DNA, 601 bp, Human; identical to SEQ ID NO: 6022

SEQ ID NO: 10087 - DNA, 601 bp, Human; identical to SEQ ID NO: 6023

SEQ ID NO: 10088 - DNA, 601 bp, Human; identical to SEQ ID NO: 6024

SEQ ID NO: 10089 - DNA, 601 bp, Human; identical to SEQ ID NO: 6025

SEQ ID NO: 10090 - DNA, 601 bp, Human; identical to SEQ ID NO: 6026

SEQ ID NO: 10091 - DNA, 601 bp, Human; identical to SEQ ID NO: 6027

SEQ ID NO: 10092 - DNA, 601 bp, Human; identical to SEQ ID NO: 6028

SEQ ID NO: 10093 - DNA, 601 bp, Human; identical to SEQ ID NO: 6029

SEQ ID NO: 10094 - DNA, 601 bp, Human; identical to SEQ ID NO: 6030

SEQ ID NO: 10095 - DNA, 601 bp, Human; identical to SEQ ID NO: 6031

SEQ ID NO: 10096 - DNA, 601 bp, Human; identical to SEQ ID NO: 6032

SEQ ID NO: 10097 - DNA, 601 bp, Human; identical to SEQ ID NO: 6033

SEQ ID NO: 10098 - DNA, 601 bp, Human; identical to SEQ ID NO: 6034

SEQ ID NO: 10099 - DNA, 601 bp, Human; identical to SEQ ID NO: 6035

SEQ ID NO: 10100 - DNA, 601 bp, Human; identical to SEQ ID NO: 6036

SEQ ID NO: 10101 - DNA, 601 bp, Human; identical to SEQ ID NO: 6037

SEQ ID NO: 10102 - DNA, 601 bp, Human; identical to SEQ ID NO: 6038

SEQ ID NO: 10103 - DNA, 601 bp, Human; identical to SEQ ID NO: 6039

SEQ ID NO: 10104 - DNA, 601 bp, Human; identical to SEQ ID NO: 6040

SEQ ID NO: 10105 - DNA, 601 bp, Human; identical to SEQ ID NO: 6041

SEQ ID NO: 10106 - DNA, 601 bp, Human; identical to SEQ ID NO: 6042

SEQ ID NO: 10107 - DNA, 601 bp, Human; identical to SEQ ID NO: 6043

SEQ ID NO: 10108 - DNA, 601 bp, Human; identical to SEQ ID NO: 6044

SEQ ID NO: 10109 - DNA, 601 bp, Human; identical to SEQ ID NO: 6045

SEQ ID NO: 10110 - DNA, 601 bp, Human; identical to SEQ ID NO: 6046

SEQ ID NO: 10111 - DNA, 601 bp, Human; identical to SEQ ID NO: 6047

SEQ ID NO: 10112 - DNA, 601 bp, Human; identical to SEQ ID NO: 6048

SEQ ID NO: 10113 - DNA, 601 bp, Human; identical to SEQ ID NO: 6049

SEQ ID NO: 10114 - DNA, 601 bp, Human; identical to SEQ ID NO: 6050

SEQ ID NO: 10115 - DNA, 601 bp, Human; identical to SEQ ID NO: 6051

SEQ ID NO: 10116 - DNA, 601 bp, Human; identical to SEQ ID NO: 6052

SEQ ID NO: 10117 - DNA, 601 bp, Human; identical to SEQ ID NO: 6053

SEQ ID NO: 10118 - DNA, 601 bp, Human; identical to SEQ ID NO: 6054

SEQ ID NO: 10119 - DNA, 601 bp, Human; identical to SEQ ID NO: 6055

SEQ ID NO: 10120 - DNA, 601 bp, Human; identical to SEQ ID NO: 6056

SEQ ID NO: 10121 - DNA, 601 bp, Human; identical to SEQ ID NO: 6057

SEQ ID NO: 10122 - DNA, 601 bp, Human; identical to SEQ ID NO: 6058

SEQ ID NO: 10123 - DNA, 601 bp, Human; identical to SEQ ID NO: 6059

SEQ ID NO: 10124 - DNA, 601 bp, Human; identical to SEQ ID NO: 6060

SEQ ID NO: 10125 - DNA, 601 bp, Human; identical to SEQ ID NO: 6061

SEQ ID NO: 10126 - DNA, 601 bp, Human; identical to SEQ ID NO: 6062

SEQ ID NO: 10127 - DNA, 601 bp, Human; identical to SEQ ID NO: 6063

SEQ ID NO: 10128 - DNA, 601 bp, Human; identical to SEQ ID NO: 6064

SEQ ID NO: 10129 - DNA, 601 bp, Human; identical to SEQ ID NO: 6065

SEQ ID NO: 10130 - DNA, 601 bp, Human; identical to SEQ ID NO: 6066

SEQ ID NO: 10131 - DNA, 601 bp, Human; identical to SEQ ID NO: 6067

SEQ ID NO: 10132 - DNA, 601 bp, Human; identical to SEQ ID NO: 6068

SEQ ID NO: 10133 - DNA, 601 bp, Human; identical to SEQ ID NO: 6069

SEQ ID NO: 10134 - DNA, 601 bp, Human; identical to SEQ ID NO: 6070

SEQ ID NO: 10135 - DNA, 601 bp, Human; identical to SEQ ID NO: 6071

SEQ ID NO: 10136 - DNA, 601 bp, Human; identical to SEQ ID NO: 6072

SEQ ID NO: 10137 - DNA, 601 bp, Human; identical to SEQ ID NO: 6073

SEQ ID NO: 10138 - DNA, 601 bp, Human; identical to SEQ ID NO: 6074

SEQ ID NO: 10139 - DNA, 601 bp, Human; identical to SEQ ID NO: 6075

SEQ ID NO: 10140 - DNA, 601 bp, Human; identical to SEQ ID NO: 6076

SEQ ID NO: 10141 - DNA, 601 bp, Human; identical to SEQ ID NO: 6077

SEQ ID NO: 10142 - DNA, 601 bp, Human; identical to SEQ ID NO: 6078

SEQ ID NO: 10143 - DNA, 601 bp, Human; identical to SEQ ID NO: 6079

SEQ ID NO: 10144 - DNA, 601 bp, Human; identical to SEQ ID NO: 6080

SEQ ID NO: 10145 - DNA, 601 bp, Human; identical to SEQ ID NO: 6081

SEQ ID NO: 10146 - DNA, 601 bp, Human; identical to SEQ ID NO: 6082

SEQ ID NO: 10147 - DNA, 601 bp, Human; identical to SEQ ID NO: 6083

SEQ ID NO: 10148 - DNA, 601 bp, Human; identical to SEQ ID NO: 6084

SEQ ID NO: 10149 - DNA, 601 bp, Human; identical to SEQ ID NO: 6085

SEQ ID NO: 10150 - DNA, 601 bp, Human; identical to SEQ ID NO: 6086

SEQ ID NO: 10151 - DNA, 601 bp, Human; identical to SEQ ID NO: 6087

SEQ ID NO: 10152 - DNA, 601 bp, Human; identical to SEQ ID NO: 6088

SEQ ID NO: 10153 - DNA, 601 bp, Human; identical to SEQ ID NO: 6089

SEQ ID NO: 10154 - DNA, 601 bp, Human; identical to SEQ ID NO: 6090

SEQ ID NO: 10155 - DNA, 601 bp, Human; identical to SEQ ID NO: 6091

SEQ ID NO: 10156 - DNA, 601 bp, Human; identical to SEQ ID NO: 6092

SEQ ID NO: 10157 - DNA, 601 bp, Human; identical to SEQ ID NO: 6093

SEQ ID NO: 10158 - DNA, 601 bp, Human; identical to SEQ ID NO: 6094

SEQ ID NO: 10159 - DNA, 601 bp, Human; identical to SEQ ID NO: 6095

SEQ ID NO: 10160 - DNA, 601 bp, Human; identical to SEQ ID NO: 6096

SEQ ID NO: 10161 - DNA, 601 bp, Human; identical to SEQ ID NO: 6097

SEQ ID NO: 10162 - DNA, 601 bp, Human; identical to SEQ ID NO: 6098

SEQ ID NO: 10163 - DNA, 601 bp, Human; identical to SEQ ID NO: 6099

SEQ ID NO: 10164 - DNA, 601 bp, Human; identical to SEQ ID NO: 6100

SEQ ID NO: 10165 - DNA, 601 bp, Human; identical to SEQ ID NO: 6101

SEQ ID NO: 10166 - DNA, 601 bp, Human; identical to SEQ ID NO: 6102

SEQ ID NO: 10167 - DNA, 601 bp, Human; identical to SEQ ID NO: 6103

SEQ ID NO: 10168 - DNA, 601 bp, Human; identical to SEQ ID NO: 6104

SEQ ID NO: 10169 - DNA, 601 bp, Human; identical to SEQ ID NO: 6105

SEQ ID NO: 10170 - DNA, 601 bp, Human; identical to SEQ ID NO: 6106

SEQ ID NO: 10171 - DNA, 601 bp, Human; identical to SEQ ID NO: 6107

SEQ ID NO: 10172 - DNA, 601 bp, Human; identical to SEQ ID NO: 6108

SEQ ID NO: 10173 - DNA, 601 bp, Human; identical to SEQ ID NO: 6109

SEQ ID NO: 10174 - DNA, 601 bp, Human; identical to SEQ ID NO: 6110

SEQ ID NO: 10175 - DNA, 601 bp, Human; identical to SEQ ID NO: 6111

SEQ ID NO: 10176 - DNA, 601 bp, Human; identical to SEQ ID NO: 6112

SEQ ID NO: 10177 - DNA, 601 bp, Human; identical to SEQ ID NO: 6113

SEQ ID NO: 10178 - DNA, 601 bp, Human; identical to SEQ ID NO: 6114

SEQ ID NO: 10179 - DNA, 601 bp, Human; identical to SEQ ID NO: 6115

SEQ ID NO: 10180 - DNA, 601 bp, Human; identical to SEQ ID NO: 6116

SEQ ID NO: 10181 - DNA, 601 bp, Human; identical to SEQ ID NO: 6117

SEQ ID NO: 10182 - DNA, 601 bp, Human; identical to SEQ ID NO: 6118

SEQ ID NO: 10183 - DNA, 601 bp, Human; identical to SEQ ID NO: 6119

SEQ ID NO: 10184 - DNA, 601 bp, Human; identical to SEQ ID NO: 6120

SEQ ID NO: 10185 - DNA, 601 bp, Human; identical to SEQ ID NO: 6121

SEQ ID NO: 10186 - DNA, 601 bp, Human; identical to SEQ ID NO: 6122

SEQ ID NO: 10187 - DNA, 601 bp, Human; identical to SEQ ID NO: 6123

SEQ ID NO: 10188 - DNA, 601 bp, Human; identical to SEQ ID NO: 6124

SEQ ID NO: 10189 - DNA, 601 bp, Human; identical to SEQ ID NO: 6125

SEQ ID NO: 10190 - DNA, 601 bp, Human; identical to SEQ ID NO: 6126

SEQ ID NO: 10191 - DNA, 601 bp, Human; identical to SEQ ID NO: 6127

SEQ ID NO: 10192 - DNA, 601 bp, Human; identical to SEQ ID NO: 6128

SEQ ID NO: 10193 - DNA, 601 bp, Human; identical to SEQ ID NO: 6129

SEQ ID NO: 10194 - DNA, 601 bp, Human; identical to SEQ ID NO: 6130

SEQ ID NO: 10195 - DNA, 601 bp, Human; identical to SEQ ID NO: 6131

SEQ ID NO: 10196 - DNA, 601 bp, Human; identical to SEQ ID NO: 6132

SEQ ID NO: 10197 - DNA, 601 bp, Human; identical to SEQ ID NO: 6133

SEQ ID NO: 10198 - DNA, 601 bp, Human; identical to SEQ ID NO: 6134

SEQ ID NO: 10199 - DNA, 601 bp, Human; identical to SEQ ID NO: 6135

SEQ ID NO: 10200 - DNA, 601 bp, Human; identical to SEQ ID NO: 6136

SEQ ID NO: 10201 - DNA, 601 bp, Human; identical to SEQ ID NO: 6137

SEQ ID NO: 10202 - DNA, 601 bp, Human; identical to SEQ ID NO: 6138

SEQ ID NO: 10203 - DNA, 601 bp, Human; identical to SEQ ID NO: 6139

SEQ ID NO: 10204 - DNA, 601 bp, Human; identical to SEQ ID NO: 6140

SEQ ID NO: 10205 - DNA, 601 bp, Human; identical to SEQ ID NO: 6141

SEQ ID NO: 10206 - DNA, 601 bp, Human; identical to SEQ ID NO: 6142

SEQ ID NO: 10207 - DNA, 601 bp, Human; identical to SEQ ID NO: 6143

SEQ ID NO: 10208 - DNA, 601 bp, Human; identical to SEQ ID NO: 6144

SEQ ID NO: 10209 - DNA, 601 bp, Human; identical to SEQ ID NO: 6145

SEQ ID NO: 10210 - DNA, 601 bp, Human; identical to SEQ ID NO: 6146

SEQ ID NO: 10211 - DNA, 601 bp, Human; identical to SEQ ID NO: 6147

SEQ ID NO: 10212 - DNA, 601 bp, Human; identical to SEQ ID NO: 6148

SEQ ID NO: 10213 - DNA, 601 bp, Human; identical to SEQ ID NO: 6149

SEQ ID NO: 10214 - DNA, 601 bp, Human; identical to SEQ ID NO: 6150

SEQ ID NO: 10215 - DNA, 601 bp, Human; identical to SEQ ID NO: 6151

SEQ ID NO: 10216 - DNA, 601 bp, Human; identical to SEQ ID NO: 6152

SEQ ID NO: 10217 - DNA, 601 bp, Human; identical to SEQ ID NO: 6153

SEQ ID NO: 10218 - DNA, 601 bp, Human; identical to SEQ ID NO: 6154

SEQ ID NO: 10219 - DNA, 601 bp, Human; identical to SEQ ID NO: 6155

SEQ ID NO: 10220 - DNA, 601 bp, Human; identical to SEQ ID NO: 6156

SEQ ID NO: 10221 - DNA, 601 bp, Human; identical to SEQ ID NO: 6157

SEQ ID NO: 10222 - DNA, 601 bp, Human; identical to SEQ ID NO: 6158

SEQ ID NO: 10223 - DNA, 601 bp, Human; identical to SEQ ID NO: 6159

SEQ ID NO: 10224 - DNA, 601 bp, Human; identical to SEQ ID NO: 6160

SEQ ID NO: 10225 - DNA, 601 bp, Human; identical to SEQ ID NO: 6161

SEQ ID NO: 10226 - DNA, 601 bp, Human; identical to SEQ ID NO: 6162

SEQ ID NO: 10227 - DNA, 601 bp, Human; identical to SEQ ID NO: 6163

SEQ ID NO: 10228 - DNA, 601 bp, Human; identical to SEQ ID NO: 6164

SEQ ID NO: 10229 - DNA, 601 bp, Human; identical to SEQ ID NO: 6165

SEQ ID NO: 10230 - DNA, 601 bp, Human; identical to SEQ ID NO: 6166

SEQ ID NO: 10231 - DNA, 601 bp, Human; identical to SEQ ID NO: 6167

SEQ ID NO: 10232 - DNA, 601 bp, Human; identical to SEQ ID NO: 6168

SEQ ID NO: 10233 - DNA, 601 bp, Human; identical to SEQ ID NO: 6169

SEQ ID NO: 10234 - DNA, 601 bp, Human; identical to SEQ ID NO: 6170

SEQ ID NO: 10235 - DNA, 601 bp, Human; identical to SEQ ID NO: 6171

SEQ ID NO: 10236 - DNA, 601 bp, Human; identical to SEQ ID NO: 6172

SEQ ID NO: 10237 - DNA, 601 bp, Human; identical to SEQ ID NO: 6173

SEQ ID NO: 10238 - DNA, 601 bp, Human; identical to SEQ ID NO: 3561

SEQ ID NO: 10239 - DNA, 601 bp, Human; identical to SEQ ID NO: 3562

SEQ ID NO: 10240 - DNA, 601 bp, Human; identical to SEQ ID NO: 6176

SEQ ID NO: 10241 - DNA, 601 bp, Human; identical to SEQ ID NO: 6177

SEQ ID NO: 10242 - DNA, 601 bp, Human; identical to SEQ ID NO: 6178

SEQ ID NO: 10243 - DNA, 601 bp, Human; identical to SEQ ID NO: 6179

SEQ ID NO: 10244 - DNA, 601 bp, Human; identical to SEQ ID NO: 6180

SEQ ID NO: 10245 - DNA, 601 bp, Human; identical to SEQ ID NO: 6181

SEQ ID NO: 10246 - DNA, 601 bp, Human; identical to SEQ ID NO: 6182

SEQ ID NO: 10247 - DNA, 601 bp, Human; identical to SEQ ID NO: 6183

SEQ ID NO: 10248 - DNA, 601 bp, Human; identical to SEQ ID NO: 6184

SEQ ID NO: 10249 - DNA, 601 bp, Human; identical to SEQ ID NO: 6185

SEQ ID NO: 10250 - DNA, 601 bp, Human; identical to SEQ ID NO: 6186

SEQ ID NO: 10251 - DNA, 601 bp, Human; identical to SEQ ID NO: 6187

SEQ ID NO: 10252 - DNA, 601 bp, Human; identical to SEQ ID NO: 6188

SEQ ID NO: 10253 - DNA, 601 bp, Human; identical to SEQ ID NO: 6189

SEQ ID NO: 10254 - DNA, 601 bp, Human; identical to SEQ ID NO: 6190

SEQ ID NO: 10255 - DNA, 601 bp, Human; identical to SEQ ID NO: 6191

SEQ ID NO: 10256 - DNA, 601 bp, Human; identical to SEQ ID NO: 6192

SEQ ID NO: 10257 - DNA, 601 bp, Human; identical to SEQ ID NO: 6193

SEQ ID NO: 10258 - DNA, 601 bp, Human; identical to SEQ ID NO: 6194

SEQ ID NO: 10259 - DNA, 601 bp, Human; identical to SEQ ID NO: 6195

SEQ ID NO: 10260 - DNA, 601 bp, Human; identical to SEQ ID NO: 6196

SEQ ID NO: 10261 - DNA, 601 bp, Human; identical to SEQ ID NO: 6197

SEQ ID NO: 10262 - DNA, 601 bp, Human; identical to SEQ ID NO: 6198

SEQ ID NO: 10263 - DNA, 601 bp, Human; identical to SEQ ID NO: 6199

SEQ ID NO: 10264 - DNA, 601 bp, Human; identical to SEQ ID NO: 6200

SEQ ID NO: 10265 - DNA, 601 bp, Human; identical to SEQ ID NO: 6201

SEQ ID NO: 10266 - DNA, 601 bp, Human; identical to SEQ ID NO: 6202

SEQ ID NO: 10267 - DNA, 601 bp, Human; identical to SEQ ID NO: 6203

SEQ ID NO: 10268 - DNA, 601 bp, Human; identical to SEQ ID NO: 6204

SEQ ID NO: 10269 - DNA, 601 bp, Human; identical to SEQ ID NO: 6205

SEQ ID NO: 10270 - DNA, 601 bp, Human; identical to SEQ ID NO: 6206

SEQ ID NO: 10271 - DNA, 601 bp, Human; identical to SEQ ID NO: 6207

SEQ ID NO: 10272 - DNA, 601 bp, Human; identical to SEQ ID NO: 6208

SEQ ID NO: 10273 - DNA, 601 bp, Human; identical to SEQ ID NO: 6209

SEQ ID NO: 10274 - DNA, 601 bp, Human; identical to SEQ ID NO: 6210

SEQ ID NO: 10275 - DNA, 601 bp, Human; identical to SEQ ID NO: 6211

SEQ ID NO: 10276 - DNA, 601 bp, Human; identical to SEQ ID NO: 6212

SEQ ID NO: 10277 - DNA, 601 bp, Human; identical to SEQ ID NO: 6213

SEQ ID NO: 10278 - DNA, 601 bp, Human; identical to SEQ ID NO: 6214

SEQ ID NO: 10279 - DNA, 601 bp, Human; identical to SEQ ID NO: 6215

SEQ ID NO: 10280 - DNA, 601 bp, Human; identical to SEQ ID NO: 6216

SEQ ID NO: 10281 - DNA, 601 bp, Human; identical to SEQ ID NO: 6217

SEQ ID NO: 10282 - DNA, 601 bp, Human; identical to SEQ ID NO: 6218

SEQ ID NO: 10283 - DNA, 601 bp, Human; identical to SEQ ID NO: 6219

SEQ ID NO: 10284 - DNA, 601 bp, Human; identical to SEQ ID NO: 6220

SEQ ID NO: 10285 - DNA, 601 bp, Human; identical to SEQ ID NO: 6221

SEQ ID NO: 10286 - DNA, 601 bp, Human; identical to SEQ ID NO: 6222

SEQ ID NO: 10287 - DNA, 601 bp, Human; identical to SEQ ID NO: 6223

SEQ ID NO: 10288 - DNA, 601 bp, Human; identical to SEQ ID NO: 6224

SEQ ID NO: 10289 - DNA, 601 bp, Human; identical to SEQ ID NO: 6225

SEQ ID NO: 10290 - DNA, 601 bp, Human; identical to SEQ ID NO: 6226

SEQ ID NO: 10291 - DNA, 601 bp, Human; identical to SEQ ID NO: 6227

SEQ ID NO: 10292 - DNA, 601 bp, Human; identical to SEQ ID NO: 6228

SEQ ID NO: 10293 - DNA, 601 bp, Human; identical to SEQ ID NO: 6229

SEQ ID NO: 10294 - DNA, 601 bp, Human; identical to SEQ ID NO: 6230

SEQ ID NO: 10295 - DNA, 601 bp, Human; identical to SEQ ID NO: 6231

SEQ ID NO: 10296 - DNA, 601 bp, Human; identical to SEQ ID NO: 6232

SEQ ID NO: 10297 - DNA, 601 bp, Human; identical to SEQ ID NO: 6233

SEQ ID NO: 10298 - DNA, 601 bp, Human; identical to SEQ ID NO: 6234

SEQ ID NO: 10299 - DNA, 601 bp, Human; identical to SEQ ID NO: 6235

SEQ ID NO: 10300 - DNA, 601 bp, Human; identical to SEQ ID NO: 6236

SEQ ID NO: 10301 - DNA, 601 bp, Human; identical to SEQ ID NO: 6237

SEQ ID NO: 10302 - DNA, 601 bp, Human; identical to SEQ ID NO: 6238

SEQ ID NO: 10303 - DNA, 601 bp, Human; identical to SEQ ID NO: 6239

SEQ ID NO: 10304 - DNA, 601 bp, Human; identical to SEQ ID NO: 6240

SEQ ID NO: 10305 - DNA, 601 bp, Human; identical to SEQ ID NO: 3563

SEQ ID NO: 10306 - DNA, 601 bp, Human; identical to SEQ ID NO: 3564

SEQ ID NO: 10307 - DNA, 601 bp, Human; identical to SEQ ID NO: 3565

SEQ ID NO: 10308 - DNA, 601 bp, Human; identical to SEQ ID NO: 3566

SEQ ID NO: 10309 - DNA, 601 bp, Human; identical to SEQ ID NO: 3567

SEQ ID NO: 10310 - DNA, 601 bp, Human; identical to SEQ ID NO: 3568

SEQ ID NO: 10311 - DNA, 601 bp, Human; identical to SEQ ID NO: 3569

SEQ ID NO: 10312 - DNA, 601 bp, Human; identical to SEQ ID NO: 3570

SEQ ID NO: 10313 - DNA, 601 bp, Human; identical to SEQ ID NO: 3571

SEQ ID NO: 10314 - DNA, 601 bp, Human; identical to SEQ ID NO: 3572

SEQ ID NO: 10315 - DNA, 601 bp, Human; identical to SEQ ID NO: 3573

SEQ ID NO: 10316 - DNA, 601 bp, Human; identical to SEQ ID NO: 3574

SEQ ID NO: 10317 - DNA, 601 bp, Human; identical to SEQ ID NO: 3575

SEQ ID NO: 10318 - DNA, 601 bp, Human; identical to SEQ ID NO: 3576

SEQ ID NO: 10319 - DNA, 601 bp, Human
ggaaccaggggaggctgagcagagccccagctctgcccctcagtcagcacaactatctttaatacataaaaggcaatttcacttactgggctaaatgcagaggatcctaccaccaaaatgagtgaagggctgcggccaggtgggtggtctctgtgaggtggggacacttcggttgcatctgctcactgtccttaccagacctccctctgccccacttctaccttgcaggaaaagcagggggcaatcagctggggtgcaggccagccacacacacacatatgggggccccaccagctcctgytcctgctcctgctccctgaaccagcatgcctgtgcagggcctgcctcccattccctctgcctcctccctgcctggggtgggtgcggcgggcggggagccatgcttagctggccttgttctccaactcagcttttccgaagctccccctggggccacggcagatgttctgccccgctccttctgctgagggcctgtgggaaggggaatagctgggtggttctggcctcactgggcccccagcaacttaccaacaactcacttcggacttctaacccttcattaagtctgggcacatcttaa

SEQ ID NO: 10320 - DNA, 601 bp, Human
tggtggccgcaggaaccaggagccaggaggatggaaggagccacgcagtggtcctcctgtcccaactgggcaagacggtgcctaacctggaaatggaagctgggcatgaccactcagggtccttgcgggaaagggtgggagagaagatgattgctttccagatgtaaaatcacagcgtgagagaacagtgatgcacaggacagggaaacatacagacccacattcagggattctgacagcagcccgggaggagcccgtcttccacgttcccccaacatccccacaccgaatcctgatctargtcggttccagcctgtgctcctcgggaaccaggggaggctgagcagagccccagctctgcccctcagtcagcacaactatctttaatacataaaaggcaatttcacttactgggctaaatgcagaggatcctaccaccaaaatgagtgaagggctgcggccaggtgggtggtctctgtgaggtggggacacttcggttgcatctgctcactgtccttaccagacctccctctgccccacttctaccttgcaggaaaagcagggggcaatcagctggggtgcaggccagccacacacacac

SEQ ID NO: 10321 - DNA, 601 bp, Human
tgctggcaccctgaccttgggcttcccagcctccaggactgcgaagaacaaggctctgttgtgtaagccacccagtctgcggtatttctgttagagcagccgaagctgaggaagatggagtgtgagctgtcctggcaccgtggaaggctgcggccggggcagactctaagtcactggtggccgcaggaaccaggagccaggaggatggaaggagccacgcagtggtcctcctgtcccaactgggcaagacggtgcctaacctggaaatggaagctgggcatgaccactcagggtccttgcrggaaagggtgggagagaagatgattgctttccagatgtaaaatcacagcgtgagagaacagtgatgcacaggacagggaaacatacagacccacattcagggattctgacagcagcccgggaggagcccgtcttccacgttcccccaacatccccacaccgaatcctgatctaggtcggttccagcctgtgctcctcgggaaccaggggaggctgagcagagccccagctctgcccctcagtcagcacaactatctttaatacataaaaggcaatttcacttactgggctaaatgcagag

SEQ ID NO: 10322 - DNA, 601 bp, Human
cagtgtgggggccttcgggaagcgttaggtgatggccctcatgagtgggactgatgtcctcatgagaagagacctgagagagatgccctctctccctgccatgtgaggagaccacaggaagatggcaagccaggaagagggtcctcccagaagccaaccttgctggcaccctgaccttgggcttcccagcctccaggactgcgaagaacaaggctctgttgtgtaagccacccagtctgcggtatttctgttagagcagccgaagctgaggaagatggagtgtgagctgtcctggcaccgyggaaggctgcggccggggcagactctaagtcactggtggccgcaggaaccaggagccaggaggatggaaggagccacgcagtggtcctcctgtcccaactgggcaagacggtgcctaacctggaaatggaagctgggcatgaccactcagggtccttgcgggaaagggtgggagagaagatgattgctttccagatgtaaaatcacagcgtgagagaacagtgatgcacaggacagggaaacatacagacccacattcagggattctgacagcagcccgggaggagcccgtcttccacgt

SEQ ID NO: 10323 - DNA, 601 bp, Human
cctcccgtgcttccttcctggtcctcctcgctcgggcaagccccacctagcgcccacctgtgcccacatctccccttccttcctagcaaaggcccctcattctcatgccttgctaaaaccctcccagacctgcctttgtggcagtctgagccacgtggggactgcagaggccgccactctggattctccctcccagacggaggggggtactgtgggcaggtggtcaagggctcctcccatcaggctgggccaacaggaactggctggggccaggcaggcctggctcccggcccctgggggktcctagccatctctttcctgggcaccattacctcatctcttgcccccaaagctcccctcactcgagcatggaggggaggggaacaacccagagaaatgctggctggcgttcccctcagccagtggcgcaggtggggttgcaggcgaggaggggcccaggtaaggcagtgctgtggcctgagtgcgtgtgtcccctcaaattcatatggtgaagccctaacccccagtgtgggggccttcgggaagcgttaggtgatggccctcatgagtgggactgatgtcctcatgagaagagacctga

SEQ ID NO: 10324 - DNA, 601 bp, Human
cgtcctcctgtgtccatgcctgagctgctcccctcccgtgcttccttcctggtcctcctcgctcgggcaagccccacctagcgcccacctgtgcccacatctccccttccttcctagcaaaggcccctcattctcatgccttgctaaaaccctcccagacctgcctttgtggcagtctgagccacgtggggactgcagaggccgccactctggattctccctcccagacggaggggggtactgtgggcaggtggtcaagggctcctcccatcaggctgggccaacaggaactggctggggycaggcaggcctggctcccggcccctggggggtcctagccatctctttcctgggcaccattacctcatctcttgcccccaaagctcccctcactcgagcatggaggggaggggaacaacccagagaaatgctggctggcgttcccctcagccagtggcgcaggtggggttgcaggcgaggaggggcccaggtaaggcagtgctgtggcctgagtgcgtgtgtcccctcaaattcatatggtgaagccctaacccccagtgtgggggccttcgggaagcgttaggtgatggccctcatgagt

SEQ ID NO: 10325 - DNA, 601 bp, Human
aagatctgagggaaatggccagcacacagcctgtattctgcaatgaccctagatgagttggcacagcggtgtggcgagtatttctggaagctactattacacctggacagacacaatcatttaactctacttgtaagagacagaatcatggcaataagccaaaacaaatgccctcaatccattttctctgtagccaaagcagcaaaatgcccaaggccattctaatggcacccacaggaggggaagtgtatcagtggcacccacgggaggagaattgtatcaatgagaagcaggaatgaaragagaagtgctgttaatcaagtatggttaaaatatcttatttttgcaaaatttacaaaaatgtgaccatgtaaacacatggcttggcctctcccagggtctcggaaggggctcctgtgagcaagggaccccaaagcgtaagcatcatgagcttcatggtaaatcgacttctgcttccctcccaaagcccctccatggctccccactcgcagcaggacaagccctgtggctggcatcaaagactcggtacgactggcctctacttacgcctcagggtcaccttcccccagcacagcagcac

SEQ ID NO: 10326 - DNA, 601 bp, Human
cctttctaaagaaatatccatgttggatctgtgtttaaagtactccatctataaaacaaacctaaaaatcaaacaaaatactgcccatatagaagtagtgacaacctccggtaccgctgaggcacctttttctgcaaagatctgagggaaatggccagcacacagcctgtattctgcaatgaccctagatgagttggcacagcggtgtggcgagtatttctggaagctactattacacctggacagacacaatcatttaactctacttgtaagagacagaatcatggcaataagccaaaamaaatgccctcaatccattttctctgtagccaaagcagcaaaatgcccaaggccattctaatggcacccacaggaggggaagtgtatcagtggcacccacgggaggagaattgtatcaatgagaagcaggaatgaaaagagaagtgctgttaatcaagtatggttaaaatatcttatttttgcaaaatttacaaaaatgtgaccatgtaaacacatggcttggcctctcccagggtctcggaaggggctcctgtgagcaagggaccccaaagcgtaagcatcatgagcttcatggtaaatc

SEQ ID NO: 10327 - DNA, 601 bp, Human
gatatgtgtctcttcctcctaatgagcaactgcttttggtttgatataaaacctttcttttttggtgacaatgagctttttgaagtcagagttattattttttttatttccttgctcattttctactactttagtttcatatcccattaatttttatctgaattttctttcctttctaataaataaattagaaaatgataaaaggtatatttgatacatatatccaaatcacagtctgtcatttcttccttattttatggaaacattcccaagccactttcaaaacggaagtgaaaacagygccttcagacgtaaccaacatttctgcatctcgctttcattgcggtttctcttctgtctttgaaattttttagagcccttcatttattgtcatccatatgttgtgaggctaggctaacttttatttatttatgttttatttatttatcgttttgagatggagtctcactctgtcgtccaggctggagtgcagtggcatgatcttgactcactgcaagctccacctcccgggttcaagtgattctcctgcctcagcctccccagtagctaggactataggcatgcgccaccatgcctggct

SEQ ID NO: 10328 - DNA, 601 bp, Human
ggccctggcatattgagggaaattctttctttttaaaaaatgatcagtactttaaagaagttatgggtgacgccatctgaacatttaggatgatgacatttggaggaggtgctctctggtttccgtccttgatgtggttttcagggcatttcaagttttctctgtgggagcttgactttaagacactctttggatgagcaacgctcagtagcagttgccgtggacgccctgactgcagtggcagcgttcgcagctccctggcgtctttgatgttgtcaacatttcatggcaaatcagaaaratgtctgaaccattttcctatgtgttcatcagattcactcctcttcgttaatgagactgtcaaacgctccaaggcctgttaacttctttgatatgtgtctcttcctcctaatgagcaactgcttttggtttgatataaaacctttcttttttggtgacaatgagctttttgaagtcagagttattattttttttatttccttgctcattttctactactttagtttcatatcccattaatttttatctgaattttctttcctttctaataaataaattagaaaatgataaaaggtatatt

SEQ ID NO: 10329 - DNA, 601 bp, Human
gcttcagcctcctgagtagttgggattataggtgcccaccacaaggcccagctaatttttttgtatttttagcagagacagggtttcaccatgttggccaggctggtctcaaactcctgacctcaggtgatcctcctgcctcagcctcccaaactgctgggattacaggcatgagccactgcacccggcctgtacactttaaaaagtgaatttaaatatagatctcaccttattaaagctgttagggaaaaaaaccaataccaaccaaacaggcagcagatggagttggccagcacttggscctggcatattgagggaaattctttctttttaaaaaatgatcagtactttaaagaagttatgggtgacgccatctgaacatttaggatgatgacatttggaggaggtgctctctggtttccgtccttgatgtggttttcagggcatttcaagttttctctgtgggagcttgactttaagacactctttggatgagcaacgctcagtagcagttgccgtggacgccctgactgcagtggcagcgttcgcagctccctggcgtctttgatgttgtcaacatttcatggcaaatcagaaagat

SEQ ID NO: 10330 - DNA, 601 bp, Human
tggattgaggtgactactaaagggtttggaacttttcagagtgacaaaaatgttccagcgcttgtttgttgtgatggctgtaaaactctatgaatacactgaaaatcactgaattgtacactctcttttacttatttatttatttttgagacgaagtttcgctcttgttgtcccggctggagcgaagtggcgagatctcggctcaccgcaacctctgcttcccgggttcaagtgattctcctgcttcagcctcctgagtagttgggattataggtgcccaccacaaggcccagctaatttktttgtatttttagcagagacagggtttcaccatgttggccaggctggtctcaaactcctgacctcaggtgatcctcctgcctcagcctcccaaactgctgggattacaggcatgagccactgcacccggcctgtacactttaaaaagtgaatttaaatatagatctcaccttattaaagctgttagggaaaaaaaccaataccaaccaaacaggcagcagatggagttggccagcacttggccctggcatattgagggaaattctttctttttaaaaaatgatcagtactttaaagaagt

SEQ ID NO: 10331 - DNA, 601 bp, Human
ccaagtgaaagacgccaggcgcaaaatgtcccatgttgtatgattccattgatatgaaatgtccagaattggaaaatcgataaagacagcaagaggatgagtggctacgagtggctatctggagttgggcgagagtaggatggattgaggtgactactaaagggtttggaacttttcagagtgacaaaaatgttccagcgcttgtttgttgtgatggctgtaaaactctatgaatacactgaaaatcactgaattgtacactctcttttacttatttatttatttttgagacgaagtttckctcttgttgtcccggctggagcgaagtggcgagatctcggctcaccgcaacctctgcttcccgggttcaagtgattctcctgcttcagcctcctgagtagttgggattataggtgcccaccacaaggcccagctaatttttttgtatttttagcagagacagggtttcaccatgttggccaggctggtctcaaactcctgacctcaggtgatcctcctgcctcagcctcccaaactgctgggattacaggcatgagccactgcacccggcctgtacactttaaaaagtgaatttaaatat

SEQ ID NO: 10332 - DNA, 601 bp, Human
tttgcagaccacttacactggtgagtgtgataacagacttgtatccagaataaataaaaaactcttaggattcaataataaaaatataaataactccatgaaaaaataagcaaaggatctaaatagacatttatacaaaaaatatatacaaattgccattaagcacatgaaaagacggtcatcataggtcactagggaaatacaaatcaaaaccccaatgagatatatcacttcacatgcactaggattggtataacaaataaaataacaagttttggggaggatatggagaaatctgaakcatcattgccagttggaatgtaaaacaggctgctttgggaaactggcagttcctcaaaatgtcaaacatggagttaccataaaatccaatgattccatttctaggtgtacatccaagaaaaacgacccatgcacgcaatactttgtacacgaatgtttgtgcggtatttcccatcattaccgaaaggtggaaacaacccaaatgtccatcaactaataaatgatgaatacccacacagtggattagtattcagcaacaggaaggaatgcagggctgctgcacactacaacagggatgagc

SEQ ID NO: 10333 - DNA, 601 bp, Human
aggacagacaaatataccgacggaatagaacaaaagcctagaactaaacctttacatttgataagttaaactttgacaattcaatggaaaaggaatagtctcttcaacgaatggttctgagacaactggatattcacatgcaaaagaatgacgttggacatcttcctcacacttacacaaaaattaactcaaaaatggatcacagatgtcaatgtaagagctgaaactctgagaataaaacataggagtaaatcttcttgacctaagtaatggtttctcaaatacaacaccaaaagcacargtgataaaagtaaaaatagataaattagacttcatcaaaattaaacacttttgcacctcaatgatgccatcacgaaagtgaaaagacaacccacagaatgggaggaaatatttgcagaccacttacactggtgagtgtgataacagacttgtatccagaataaataaaaaactcttaggattcaataataaaaatataaataactccatgaaaaaataagcaaaggatctaaatagacatttatacaaaaaatatatacaaattgccattaagcacatgaaaagacggtcatcataggtc

SEQ ID NO: 10334 - DNA, 601 bp, Human
accttagtaataaattgaacaaaaggaatgcaaaacgtgtccactaaaaattacaatacatcattgaaagaagttcaagttctaagtaaatggaaagacatctcaatgttcattgatcagtgttaaaatggaaatactttcacactgatctacaggttcaacataattcctatcaaaatgcagactagaattttgcaaagttgagaagctgctcctaaaattcatatggaaagtcacaggatgtagaatagccaaaataatattgaaaaaagagcaaagtgggaagacacttcaccatttygaagcttactattaaactacagtaatcaagacagtgtatccctggcataaggacagacaaatataccgacggaatagaacaaaagcctagaactaaacctttacatttgataagttaaactttgacaattcaatggaaaaggaatagtctcttcaacgaatggttctgagacaactggatattcacatgcaaaagaatgacgttggacatcttcctcacacttacacaaaaattaactcaaaaatggatcacagatgtcaatgtaagagctgaaactctgagaataaaacataggagtaa

SEQ ID NO: 10335 - DNA, 601 bp, Human
aatggcagttaaaacagtatattatctttattttcagacaaaatgatcttctgtatagaaaatcccaaagaatcccctacaaaacttaaagctaacaaacaaattaactgaggtttcaggaaacaagaccaatatacaaaaaaatcaactgcatttctataaactagtaataaatgatttaaaaatgaaattaagaaaataactccatttacaatagcaccaaaaagaaaaaaagaaccttagtaataaattgaacaaaaggaatgcaaaacgtgtccactaaaaattacaatacatcatygaaagaagttcaagttctaagtaaatggaaagacatctcaatgttcattgatcagtgttaaaatggaaatactttcacactgatctacaggttcaacataattcctatcaaaatgcagactagaattttgcaaagttgagaagctgctcctaaaattcatatggaaagtcacaggatgtagaatagccaaaataatattgaaaaaagagcaaagtgggaagacacttcaccatttcgaagcttactattaaactacagtaatcaagacagtgtatccctggcataaggacagacaaatat

SEQ ID NO: 10336 - DNA, 601 bp, Human
tagggcacaagctctgctccaggtacaccaggccaagaatggtggacctgatagcccctccccagattgcttatagggtagaggttccatgttgaaaggggcaagcccagaagactagtggctaccattcccatctagtgagcagtctgtaggccaggaatgtcactctgggagaagcaggccactgaccctgctcctttagctctggctcagtggtgcaggggcctgcccagagggagagtcagaacagaaggcttcacagctctccctaaggggactgactttgatctgaaacagagcrtggaggatgttcatgtctaagggcactgtcaaaaacaacaagggtcttagcagtgagcaattaagaggaggccaatggtcctaatagcaacaaacaaaatgttaaaccagctacaggttgagtgtcccttatctgaaatgctcggaaccagaagcgtttggaaccagaagtgtttcggatttcagattttcagattaaggatgctcaacctgtagaagttaaacagacagaaccagggacaaagacagctaagagccctcctgaaggtctcaatacacctcagatactggcaacaccctg

SEQ ID NO: 10337 - DNA, 601 bp, Human
ctcaagaaaatctattaaatcttggtaagaaaagcaaaagtctatggcattggagccacagccctcccccattcctgccctagctcagtgtgacagaagctttactgccaagaagacggggctgcctctactccaagctcccggtctgaggctacagtttcatactgagaaacccaggccactggtgtcatccctctcaactctgttgcagagtctctctctggtgggatggccaagaggcctggggcccccttcccccacccaggccccactcatagggcacaagctctgctccaggtayaccaggccaagaatggtggacctgatagcccctccccagattgcttatagggtagaggttccatgttgaaaggggcaagcccagaagactagtggctaccattcccatctagtgagcagtctgtaggccaggaatgtcactctgggagaagcaggccactgaccctgctcctttagctctggctcagtggtgcaggggcctgcccagagggagagtcagaacagaaggcttcacagctctccctaaggggactgactttgatctgaaacagagcgtggaggatgttcatgtctaagggca

SEQ ID NO: 10338 - DNA, 601 bp, Human
gttggagtgcagtgacgatcttggctcactgcaacctccgcctcctgggttcaagcgattctcttgcctcagcctcccgagtagctgggattacaggtgtccaccaccacccccagctaatttttgcattttttttttttttatttttagtagacacagggttttgccatgttggccaggctggtctcgaactcctgacctcaggtgatccacctgcctcagccttccaaagtgctaggattacaggcgtgagccaccgcgcccggccgactgcatactctttaacccttctttgtatgayctaattttgtagcactgtttccacaaagagaacagaaagagaacgcagccattccttggcaaactcttctcagcaaaccattcctcagcaaattctttctgtaaaagggccagagagtaactattgtagactttgcaggctatataatctctgttgcaattaatcaattctgccatcagagcttgaaagcagctatagacaacctataaatgaatggacatggctgtgttccttattggaactttattttgtaaactttatttacaaaaacaggcagcaaacagaaactttgaatggaag

SEQ ID NO: 10339 - DNA, 601 bp, Human
tcacacaaaaacgttttaaaactgacaatgaccaaacaaccaaaaaacagagaacaaggacttctaatacattgactgacagaacttttccttcagttccgactgcatgctctttttttttttttttttttgagacagagtctcactctgtccccccaggttggagtgcagtgacgatcttggctcactgcaacctccgcctcctgggttcaagcgattctcttgcctcagcctcccgagtagctgggattacaggtgtccaccaccacccccagctaatttttgcattttttttttttttatttttagtagacacagggttttgccatgttggccaggctggtctcgaactcctgacctcaggtgatccacctgcctcagccttccaaagtgctaggattacaggcgtgagccaccgcgcccggccgactgcatactctttaacccttctttgtatgacctaattttgtagcactgtttccacaaagagaacagaaagagaacgcagccattccttggcaaactcttctcagcaaaccattcctcagcaaattctttctgtaaaagggccagagagtaactattgtagactttgcaggct

SEQ ID NO: 10340 - DNA, 601 bp, Human
gagaaaatacatcacacaaaaacgttttaaaactgacaatgaccaaacaaccaaaaaacagagaacaaggacttctaatacattgactgacagaacttttccttcagttccgactgcatgctctttttttttttttttttttgagacagagtctcactctgtccccccaggttggagtgcagtgacgatcttggctcactgcaacctccgcctcctgggttcaagcgattctcttgcctcagcctcccgagtagctgggattacaggtgtccaccaccacccccagctaatttttgcattytttttttttttatttttagtagacacagggttttgccatgttggccaggctggtctcgaactcctgacctcaggtgatccacctgcctcagccttccaaagtgctaggattacaggcgtgagccaccgcgcccggccgactgcatactctttaacccttctttgtatgacctaattttgtagcactgtttccacaaagagaacagaaagagaacgcagccattccttggcaaactcttctcagcaaaccattcctcagcaaattctttctgtaaaagggccagagagtaactattgtaga

SEQ ID NO: 10341 - DNA, 601 bp, Human
ctggcatgtaggaaaaatgattccacatcttaatctgatcacagtgctctcattcctctagggggaggaagcgtctacagtttaggggacccactttaagaagaagattgcaaaattaaagaattaaattaggtgcaaaatgggttattgacttgaaatgagaaaatacatcacacaaaaacgttttaaaactgacaatgaccaaacaaccaaaaaacagagaacaaggacttctaatacattgactgacagaacttttccttcagttccgactgcatgctctttttttttttttttttttgagacagagtctcactctgtccccccaggttggagtgcagtgacgatcttggctcactgcaacctccgcctcctgggttcaagcgattctcttgcctcagcctcccgagtagctgggattacaggtgtccaccaccacccccagctaatttttgcattttttttttttttatttttagtagacacagggttttgccatgttggccaggctggtctcgaactcctgacctcaggtgatccacctgcctcagccttccaaagtgctaggattacaggcgtgagccaccgcgcccggccgact

SEQ ID NO: 10342 - DNA, 601 bp, Human
agaactggtgtgcagccacagggccctccaggacagggctggctggagagggtctcctggaccctcagctgccactcagcaaggccagggggacatggggccaactcactgtgggttgtcacactggcgggtcctgaacttcacgcccgtgccacaggtacgtgagcaggagccaaacggactccaagcgccccagctgccgtcccgtttgaggatgtcaggtgtcagccagatgcagtgtcctttaaaacaatgctgaaagacaggaagccagtccctccactcaccctcacaccgggcygtggggacagtcctgcgctctgcagcctgcagtgtctgggacacgtcctggccccactctggggcacagggggagctcaccctcctcgcccctagatgctcagagcccccagaagacaggcctcattggccagaggcaataagaggcacagtgaggggctggcctgccctgcctcccgcttgctgacccaccctcctgccttctagcagctctgtgtcccctcagctggaagctgcaccacatgacgccgccaggatagatgcctcctgggtgcccacacacagcccatttataaagata

SEQ ID NO: 10343 - DNA, 601 bp, Human
ggcggggcagcctgccctgcacctctccagaactggtgtgcagccacagggccctccaggacagggctggctggagagggtctcctggaccctcagctgccactcagcaaggccagggggacatggggccaactcactgtgggttgtcacactggcgggtcctgaacttcacgcccgtgccacaggtacgtgagcaggagccaaacggactccaagcgccccagctgccgtcccgtttgaggatgtcaggtgtcagccagatgcagtgtcctttaaaacaatgctgaaagacaggaagccrgtccctccactcaccctcacaccgggccgtggggacagtcctgcgctctgcagcctgcagtgtctgggacacgtcctggccccactctggggcacagggggagctcaccctcctcgcccctagatgctcagagcccccagaagacaggcctcattggccagaggcaataagaggcacagtgaggggctggcctgccctgcctcccgcttgctgacccaccctcctgccttctagcagctctgtgtcccctcagctggaagctgcaccacatgacgccgccaggatagatgcctcctgggt

SEQ ID NO: 10344 - DNA, 601 bp, Human; identical to SEQ ID NO: 3577

SEQ ID NO: 10345 - DNA, 601 bp, Human; identical to SEQ ID NO: 3578

SEQ ID NO: 10346 - DNA, 601 bp, Human; identical to SEQ ID NO: 3579

SEQ ID NO: 10347 - DNA, 601 bp, Human; identical to SEQ ID NO: 3580

SEQ ID NO: 10348 - DNA, 601 bp, Human; identical to SEQ ID NO: 3581

SEQ ID NO: 10349 - DNA, 601 bp, Human; identical to SEQ ID NO: 3582

SEQ ID NO: 10350 - DNA, 601 bp, Human; identical to SEQ ID NO: 3583

SEQ ID NO: 10351 - DNA, 601 bp, Human; identical to SEQ ID NO: 3584

SEQ ID NO: 10352 - DNA, 601 bp, Human; identical to SEQ ID NO: 3585

SEQ ID NO: 10353 - DNA, 601 bp, Human; identical to SEQ ID NO: 3586

SEQ ID NO: 10354 - DNA, 601 bp, Human; identical to SEQ ID NO: 3587

SEQ ID NO: 10355 - DNA, 601 bp, Human; identical to SEQ ID NO: 3588

SEQ ID NO: 10356 - DNA, 601 bp, Human; identical to SEQ ID NO: 3589

SEQ ID NO: 10357 - DNA, 601 bp, Human; identical to SEQ ID NO: 3590

SEQ ID NO: 10358 - DNA, 601 bp, Human; identical to SEQ ID NO: 3591

SEQ ID NO: 10359 - DNA, 601 bp, Human; identical to SEQ ID NO: 3592

SEQ ID NO: 10360 - DNA, 601 bp, Human; identical to SEQ ID NO: 3593

SEQ ID NO: 10361 - DNA, 601 bp, Human; identical to SEQ ID NO: 3594

SEQ ID NO: 10362 - DNA, 601 bp, Human; identical to SEQ ID NO: 3595

SEQ ID NO: 10363 - DNA, 601 bp, Human; identical to SEQ ID NO: 3596

SEQ ID NO: 10364 - DNA, 601 bp, Human; identical to SEQ ID NO: 3597

SEQ ID NO: 10365 - DNA, 601 bp, Human; identical to SEQ ID NO: 3598

SEQ ID NO: 10366 - DNA, 601 bp, Human; identical to SEQ ID NO: 3599

SEQ ID NO: 10367 - DNA, 601 bp, Human; identical to SEQ ID NO: 3600

SEQ ID NO: 10368 - DNA, 601 bp, Human; identical to SEQ ID NO: 3601

SEQ ID NO: 10369 - DNA, 601 bp, Human; identical to SEQ ID NO: 3602

SEQ ID NO: 10370 - DNA, 601 bp, Human; identical to SEQ ID NO: 3603

SEQ ID NO: 10371 - DNA, 601 bp, Human; identical to SEQ ID NO: 3604

SEQ ID NO: 10372 - DNA, 601 bp, Human; identical to SEQ ID NO: 3605

SEQ ID NO: 10373 - DNA, 601 bp, Human; identical to SEQ ID NO: 3606

SEQ ID NO: 10374 - DNA, 601 bp, Human; identical to SEQ ID NO: 3607

SEQ ID NO: 10375 - DNA, 601 bp, Human; identical to SEQ ID NO: 3608

SEQ ID NO: 10376 - DNA, 601 bp, Human; identical to SEQ ID NO: 3609

SEQ ID NO: 10377 - DNA, 601 bp, Human; identical to SEQ ID NO: 3610

SEQ ID NO: 10378 - DNA, 601 bp, Human; identical to SEQ ID NO: 3611

SEQ ID NO: 10379 - DNA, 601 bp, Human; identical to SEQ ID NO: 3612

SEQ ID NO: 10380 - DNA, 601 bp, Human; identical to SEQ ID NO: 3613

SEQ ID NO: 10381 - DNA, 601 bp, Human; identical to SEQ ID NO: 3614

SEQ ID NO: 10382 - DNA, 601 bp, Human; identical to SEQ ID NO: 3615

SEQ ID NO: 10383 - DNA, 601 bp, Human; identical to SEQ ID NO: 3616

SEQ ID NO: 10384 - DNA, 601 bp, Human; identical to SEQ ID NO: 3617

SEQ ID NO: 10385 - DNA, 601 bp, Human; identical to SEQ ID NO: 3618

SEQ ID NO: 10386 - DNA, 601 bp, Human; identical to SEQ ID NO: 3619

SEQ ID NO: 10387 - DNA, 601 bp, Human; identical to SEQ ID NO: 3620

SEQ ID NO: 10388 - DNA, 601 bp, Human; identical to SEQ ID NO: 3621

SEQ ID NO: 10389 - DNA, 601 bp, Human; identical to SEQ ID NO: 3622

SEQ ID NO: 10390 - DNA, 601 bp, Human; identical to SEQ ID NO: 3623

SEQ ID NO: 10391 - DNA, 601 bp, Human; identical to SEQ ID NO: 3624

SEQ ID NO: 10392 - DNA, 601 bp, Human; identical to SEQ ID NO: 3625

SEQ ID NO: 10393 - DNA, 601 bp, Human; identical to SEQ ID NO: 3626

SEQ ID NO: 10394 - DNA, 601 bp, Human; identical to SEQ ID NO: 3627

SEQ ID NO: 10395 - DNA, 601 bp, Human; identical to SEQ ID NO: 1263

SEQ ID NO: 10396 - DNA, 601 bp, Human; identical to SEQ ID NO: 1264

SEQ ID NO: 10397 - DNA, 601 bp, Human; identical to SEQ ID NO: 1265

SEQ ID NO: 10398 - DNA, 601 bp, Human; identical to SEQ ID NO: 1266

SEQ ID NO: 10399 - DNA, 601 bp, Human; identical to SEQ ID NO: 1267

SEQ ID NO: 10400 - DNA, 601 bp, Human; identical to SEQ ID NO: 1268

SEQ ID NO: 10401 - DNA, 601 bp, Human; identical to SEQ ID NO: 1269

SEQ ID NO: 10402 - DNA, 601 bp, Human; identical to SEQ ID NO: 1270

SEQ ID NO: 10403 - DNA, 601 bp, Human; identical to SEQ ID NO: 1271

SEQ ID NO: 10404 - DNA, 601 bp, Human; identical to SEQ ID NO: 1272

SEQ ID NO: 10405 - DNA, 601 bp, Human; identical to SEQ ID NO: 1273

SEQ ID NO: 10406 - DNA, 601 bp, Human; identical to SEQ ID NO: 1274

SEQ ID NO: 10407 - DNA, 601 bp, Human; identical to SEQ ID NO: 1275

SEQ ID NO: 10408 - DNA, 601 bp, Human; identical to SEQ ID NO: 1276

SEQ ID NO: 10409 - DNA, 601 bp, Human; identical to SEQ ID NO: 1277

SEQ ID NO: 10410 - DNA, 601 bp, Human; identical to SEQ ID NO: 1278

SEQ ID NO: 10411 - DNA, 601 bp, Human; identical to SEQ ID NO: 1279

SEQ ID NO: 10412 - DNA, 601 bp, Human; identical to SEQ ID NO: 1280

SEQ ID NO: 10413 - DNA, 601 bp, Human; identical to SEQ ID NO: 1281

SEQ ID NO: 10414 - DNA, 601 bp, Human; identical to SEQ ID NO: 1282

SEQ ID NO: 10415 - DNA, 601 bp, Human; identical to SEQ ID NO: 1283

SEQ ID NO: 10416 - DNA, 601 bp, Human; identical to SEQ ID NO: 1284

SEQ ID NO: 10417 - DNA, 601 bp, Human; identical to SEQ ID NO: 1285

SEQ ID NO: 10418 - DNA, 601 bp, Human; identical to SEQ ID NO: 1286

SEQ ID NO: 10419 - DNA, 601 bp, Human; identical to SEQ ID NO: 1287

SEQ ID NO: 10420 - DNA, 601 bp, Human; identical to SEQ ID NO: 1288

SEQ ID NO: 10421 - DNA, 601 bp, Human; identical to SEQ ID NO: 1289

SEQ ID NO: 10422 - DNA, 601 bp, Human; identical to SEQ ID NO: 1290

SEQ ID NO: 10423 - DNA, 601 bp, Human; identical to SEQ ID NO: 1291

SEQ ID NO: 10424 - DNA, 601 bp, Human; identical to SEQ ID NO: 1292

SEQ ID NO: 10425 - DNA, 601 bp, Human; identical to SEQ ID NO: 1293

SEQ ID NO: 10426 - DNA, 601 bp, Human; identical to SEQ ID NO: 1294

SEQ ID NO: 10427 - DNA, 601 bp, Human
ctaaaattctaattatgtaaggctaaagaaataccgcacgtgaacaaatatttaagtactcacccattctatgcagcattgtaataaaaagtaaaacctgaaataacctttattgcgtccactaataggacaatgtttaaacaaatgacacgtccatcatacagaatactgtgtggtcactggaaggcacatggacctgtatacactgacatgaaaagatgtggaaagaatgctgggagcgttaaaattttctgaagtacaacgtagcacaatgcatacatggtttaggctttttagaataaaaaatacttatacgcagacatttatatttacacgtataacactgtgtacagccccgaagcaatgccgaaactttcactgttgttacctccgagtggggactgggaaagcagaggttagggtcgttctctctgttttacaaacatttattggcgcatccatcaattccaggccccgaggacacagctgcgtcaacgacatcgagtccacctgctctggggacccggatgactgctataggttttgttcactgtggcgtccccagaacctgcacggcgccgggcactgagcgggcgctcac

SEQ ID NO: 10428 - DNA, 601 bp, Human
cccagcattttgggaggccaaggctagtggatcatgaggtcaggagttcgagaccaccctggccagcatagtgaaaccccatctctattaaaaatacaaaacctagctgggtgtggtggcatgcgcctgtagtcccagctacgtgggaggcgaagtcaggagaatcactcgaacccaggaggcggagggtgtggtgagctgaggttgcaccactgcactccagcctgggcaacagagcaagactccggctcaaaaaaaatcaaataagatattctgagggcaagtgacagggctggcagtrtcaggggtcagtgaggtctgaaagggtaagagggctgagctcatgggtgactgaggcagcgtagcatgggcgagaggattccacagacataagacacgcacacctgaagccaggcacatgctacaacctggaaatactttcccaagaaaagaaaaaaatttcaagaggtctggattttctacataggtggatctgcctaaactattctttctcccctgttgcacaagacatgtattttcttagctaaattctctcatcgttcaatcaatccaaacaatttaccttcccattcatccacac

SEQ ID NO: 10429 - DNA, 601 bp, Human
aactgctagcctcattcaccatcactcctgcacactcccgcaagtctttcatcaaaccaattattcagagctatctccttacccttgcacctgcagctttccagacatggaacgttcctccctcccctccagtgaaaacagccttggacactcggcccaaatcgctcctcatctgtgaaacttaccctggggcaagcagctcttgtttctctaatgtgctgtccaggccaccaagatggccctggtacactgctcagcagccacctatgactccagacagcagggtcacattttctttgamgactcgggggcattggaaatgtatttgctgaataaactgttatgggcaaaaatgacaaatataaagtccacaagcggatatcctagcccacccctcacagaaatattctgagggtaggccaggcgcagtggctcacgcctgtaatcccagcattttgggaggccaaggctagtggatcatgaggtcaggagttcgagaccaccctggccagcatagtgaaaccccatctctattaaaaatacaaaacctagctgggtgtggtggcatgcgcctgtagtcccagctacgtgggaggcgaag

SEQ ID NO: 10430 - DNA, 601 bp, Human
accttcctggtgctggcaggggacctactctcacaactctgatttccaagacaggaagttccagcaaaggctccagcttacagagaacaaaaaggcccaagatcttaacgcctgcaccaaccagtcctatcgtggttgcctcagtcatgttctggcaatttcacgaaaacaagagcatctggcatgaccaggagactggactcggcacccttggtgattgtggcagtcacctcgtcatgcaaaatgaccaacccgtcaccgtacctgcctgaccacagaatcacgtttgctttgggagacygcgtctgctgttgatctttccaggtcttccctctcctttaggaggcggcctcatccttctactggcacatctgacacttctgacagttggagctctgacgaaaagctctcatggtgggccacgtggctgggctccccacacaccaggcccagggctggctctgtgactgtcctgaggaatgcaggatgaggctcctacgcacaagcttatatctgacagaaaagacacaactgctagcctcattcaccatcactcctgcacactcccgcaagtctttcatcaaaccaattattcagagct

SEQ ID NO: 10431 - DNA, 601 bp, Human
aacactcactgtttcttgaggtttcctgtgttccagaacctggtctaatcgttctctactatgatatactgatacttcattcatcaggaaacataactccttgaacataaagaaaaagaacaaaaagcgaaagggcacctcggaatagtcaaaatatgggcctgaagccctcaccctgagctttgctcatggaagactactggccccatatgaaatccatctcattctaacaatttgatgctaacaagtttcccagccacatctgcaaactaggaaaggagagaacagggctccagacagrcctgcaagttaaggccacagtaagagaggccaaaaatataaacactcacaatgcagttttgatgtggggacacttcatagacgaaggattcttcacatttcaatggccctacgggagcctacatattaaaacagaagaccaaacattaacacccgtaataatgaccctgaaaacatccaagagaggttcagtcatgggccatcaaatgatggagtgttctagaaagacttctcatcataatggttaaaatgaaatgttttaaagtcagcctcgtggaaaattcgcttgaacattccattg

SEQ ID NO: 10432 - DNA, 601 bp, Human
agaagggcgcaccaccactcctggcctatttgcactcttttttttttttttttttttttgagataggttcttgctctttgaccaggctgaagtgcagtggcacaatcacagctcaatgtagcctcaaactcctgggctcgagcaattctcccacctcagcctcccaaatggctgggaccacaggcatgtgccaccacacccagcaatttttaaaaattttttttcgagatggagtctcactatgttgtccaggctggcattcaactcttggcctcaagcaatcctcctgccttggcctccygaagtgctgcaattacaggcatgaccaaccgcacccagcctcgtttccaccttctgatggaccttcagattgttttcattttcgggttattatgaataatgctgctatgaacattcatgtgtaggctgttctgtggacatgttttcatgtctacaaggtatgtgcctcagggtagaactgtggggtcatatggtaattcggtttgactgtgtgaggagctgcaagaatgttttcctgcagaggtcgcaccgttttacattctcaccagcagtgtgggagggttctgatttttccacatcc

SEQ ID NO: 10433 - DNA, 601 bp, Human
ttggccaggctagtctcaaactcctgacctcaagtaatccacccacgttagcctcccgaagtgctgagattgtagacatgagccactgcaccaggcccagcttccaactttttactgtaacttttgttttggggtggggtgggggtctcactatgttgcctggagtgcagtggctgtttacaggcactgtcatggtgcatggtagcctccaactggcaggcttaagcgatcctcccacctcagcctcccaagcaggtgggattagaagggcgcaccaccactcctggcctatttgcactcttttttttttttttttttttttgagataggttcttgctctttgaccaggctgaagtgcagtggcacaatcacagctcaatgtagcctcaaactcctgggctcgagcaattctcccacctcagcctcccaaatggctgggaccacaggcatgtgccaccacacccagcaatttttaaaaattttttttcgagatggagtctcactatgttgtccaggctggcattcaactcttggcctcaagcaatcctcctgccttggcctcctgaagtgctgcaattacaggcatgaccaaccgcaccca

SEQ ID NO: 10434 - DNA, 601 bp, Human
aacacttaaaaacttacgagaaacataaacacatttacaaaatttcaaacacatttttaaactattctcattctaaaattcatgtggaaaagttagtgtacataaatagccaaagaaattttgaaaaaactgaggaaattcatcaaatattaaagaacattaatataaagctacaatattaaaataaatttccagaccaggcatggctgctcacacctgtaatcccagcactttgggagggagatccaggcaggaggaggctccctcgagctcaggagctcgaggccagcctaggtaacayagggagacccccccaactctcaaaaagtaaacacacacaaaaaaaggttaaattaatttccagcagggcacaggggctcatgtttgtaaccccagtgctttggaaggccaagttgggaggaacacttgaggccaggagttctagaccagcctgggcaacatagcaagaccaacctcttatttttttttttttaatttccgctgtcacttattaagtcaaaatgaattccagatggaccatagaagtaaaaataaaagctaaaagtactgaaagaaaacatgaaagatttagtaactttat

SEQ ID NO: 10435 - DNA, 601 bp, Human
ttatgaagacagcaggtgctctgaacagcagcaagacttctcaagctttacctgttcacatggttttggttaatcaaaccatatttatttattcaaaacagatattaaattattaaaaatatgaggctgcccggcacggtggctcacacctgttatcccagcactttgggaggccaaggcaggtggatcacaaagtcaggagttcgagaccagcgtggccaacatggtgaaccctgtctctactaaaaatacaaaaattagctgggtgtggtggcgtgcacctgtaatcccagcctgggcracacagtgagactccatctcgggcgggggaaaatatgaggctgtcacaaaagtgctaatgttttccctgctgtcgatgttgaggtcacttgaaagctggtatggacacatcggatgaggaattcagtctaggggcctcttaggagccaaggcccaatgactagactaagtggacccagcaaacacagagggagggggcctgaggcacaaacacagacaaggtcctatgctcgaggcaaacaaggacgaggtacaaggtgagagccagaaggggccactgtgctgcttcacagacctggga

SEQ ID NO: 10436 - DNA, 601 bp, Human
tctaattataaggcaaggattgtcagaattggtaaaggaagacctaattacatgctatctacaagacactttaaacataaagaaaaagatacacttaagacaaatgaatggaaaaatacataccatccaaaaagtgtgtttaagaaagctggagtggctctattaatatcaagtaaaatacatttcaaaataaaaaatattattaggaaaaaagaaggatatttcagaatactacaacaaacaattcatcaggaaaatgtaatcacaagtgtgtatttgcctaataacagagcttcaacatatatgaagttaaaacggaaagaattaaagacaaaacaattccacaatcacagctggagatcttaacactcctctctcaataactgacagaatcaaaccaaaaaataaaacagaagccgggcacagtagctcacgcctgtaatcccagcactttgggaggctgaaacaggagaatcgcttgaacccgaggcagaggttgcagtgagctgagatcgcgcccctgcactccagtctgggtgacagagtaagaccctgtcccaaaaaaaaaaaaaaaaaatagccagacagtccagaagaaaaa

SEQ ID NO: 10437 - DNA, 601 bp, Human
gaggcagaggttgcggtgagccgagattgtgccattgcactccagcagcctgggtgacaagagtgaaactccgtctcaaaaaaaaaaaaaaaaaaaaagatttattcatgtatttactatttctttctttcttagaaaagagattgctctgtcacccaggctggagtgcagtggtacagtcatggctcactgcagtcttgaactcctgggctcaagggaccttcctgctttactctcctgaacagctgggactgcaggtaagcaccatcacacaggactaaattctttttttttttttttycctagagatagggtgtttccatgttgaccaggctggtcttaagctcctggtctcaagcaatcttcctaccttagcctcccaaagctgctgggattacaggtctgagccaccacgcccagcctgtgctgctcatttgaaactgctgctatatgccagcatatgacatttcccactgttaattttttggttaatgtataatttatctcaccaaattagggcaggaaaaagcttgtatttctcagtaacactctttgaagacaggaacatccatatttcttggtatgccaaagtatctatcac

SEQ ID NO: 10438 - DNA, 601 bp, Human
gcagctgcagtctcagtagctgggactccttcccatccgagttgctgcagggcctggctgcaggccctctctcccattcaggcctccctggccccagcagttcacaataatctcttcctatgagttcactgcacttaactttttatgctgcccatttaaaaaaattttatactggccaggcgcagtggctcacaccataatcccagcactttgggaggccgaggcgggtggatcacctgaggtcaggagttcaagaccagcgtgaccaacagggtgaaaccccatctctactaaaaatacaaaattagcactgggtgcctgtaatccccgctactcgggaggctgaggcaggagaatcacttgaacccacgaggcagaggttgcggtgagccgagattgtgccattgcactccagcagcctgggtgacaagagtgaaactccgtctcaaaaaaaaaaaaaaaaaaaaagatttattcatgtatttactatttctttctttcttagaaaagagattgctctgtcacccaggctggagtgcagtggtacagtcatggctcactgcagtcttgaactcctgggctcaagggaccttcctgcttt

SEQ ID NO: 10439 - DNA, 601 bp, Human
gtttgaatgtgacaccacacacccctccccttccaccccccacatccctacccactactgccagtgcccatgcagctcctccactctgcagctgcagtctcagtagctgggactccttcccatccgagttgctgcagggcctggctgcaggccctctctcccattcaggcctccctggccccagcagttcacaataatctcttcctatgagttcactgcacttaactttttatgctgcccatttaaaaaaattttatactggccaggcgcagtggctcacaccataatcccagcactttgsgaggccgaggcgggtggatcacctgaggtcaggagttcaagaccagcgtgaccaacagggtgaaaccccatctctactaaaaatacaaaattagcactgggtgcctgtaatccccgctactcgggaggctgaggcaggagaatcacttgaacccacgaggcagaggttgcggtgagccgagattgtgccattgcactccagcagcctgggtgacaagagtgaaactccgtctcaaaaaaaaaaaaaaaaaaaaagatttattcatgtatttactatttctttctttcttagaaaagagat

SEQ ID NO: 10440 - DNA, 601 bp, Human
gaagcactgatagtttgaatgtgacaccacacacccctccccttccaccccccacatccctacccactactgccagtgcccatgcagctcctccactctgcagctgcagtctcagtagctgggactccttcccatccgagttgctgcagggcctggctgcaggccctctctcccattcaggcctccctggccccagcagttcacaataatctcttcctatgagttcactgcacttaactttttatgctgcccatttaaaaaaattttatactggccaggcgcagtggctcacaccataatyccagcactttgggaggccgaggcgggtggatcacctgaggtcaggagttcaagaccagcgtgaccaacagggtgaaaccccatctctactaaaaatacaaaattagcactgggtgcctgtaatccccgctactcgggaggctgaggcaggagaatcacttgaacccacgaggcagaggttgcggtgagccgagattgtgccattgcactccagcagcctgggtgacaagagtgaaactccgtctcaaaaaaaaaaaaaaaaaaaaagatttattcatgtatttactatttctttctttct

SEQ ID NO: 10441 - DNA, 601 bp, Human
agaggaataaatctgcctgaaccagataccaaacacgctagctgtacaatttccgtctttgtgtttctcctacaccctaaaggaaaaaccacaaacctcaatgtcaggctacaagatcttactgttaaactatctggtggtttggggtcgcacaaaatgggaagcactgatagtttgaatgtgacaccacacacccctccccttccaccccccacatccctacccactactgccagtgcccatgcagctcctccactctgcagctgcagtctcagtagctgggactccttcccatccgagytgctgcagggcctggctgcaggccctctctcccattcaggcctccctggccccagcagttcacaataatctcttcctatgagttcactgcacttaactttttatgctgcccatttaaaaaaattttatactggccaggcgcagtggctcacaccataatcccagcactttgggaggccgaggcgggtggatcacctgaggtcaggagttcaagaccagcgtgaccaacagggtgaaaccccatctctactaaaaatacaaaattagcactgggtgcctgtaatccccgctactcgggagg

SEQ ID NO: 10442 - DNA, 601 bp, Human
tgggaggccaaggccggggggtcgcttcagctcaggagtttgaaattagcctgggtaacatggcaaaaccccatctctacaaaaaaacagccaggtgtggtggtgcatgcctgtagtctcagctacttgggaggatcacttgagcctgcaaggcagaggttgcagtgagccaagatcacgccactgcatttcagggtgggagatgcagccaggccctgtctcaaaaaaaaaattaaaaattaaaaaaaaaataaaccattagaggaataaatctgcctgaaccagataccaaacacgctarctgtacaatttccgtctttgtgtttctcctacaccctaaaggaaaaaccacaaacctcaatgtcaggctacaagatcttactgttaaactatctggtggtttggggtcgcacaaaatgggaagcactgatagtttgaatgtgacaccacacacccctccccttccaccccccacatccctacccactactgccagtgcccatgcagctcctccactctgcagctgcagtctcagtagctgggactccttcccatccgagttgctgcagggcctggctgcaggccctctctcccattcagg

SEQ ID NO: 10443 - DNA, 601 bp, Human
ttcctgccaagtcagtgttgagatgaaactcttggatctttgcctattggtcagataaaattttcactgtagttttcacttacatttctcttattataagcaaaactgagcactgtcccgtatttttaaatatttcctatttccttttttgttaagggactgttggtatcctctgataatttttctactacattttaaatcttcttcttattgatttgtaagagctttttatatattaaggaaattagtcgccaggagcggtggctcacacctgtaatcccagcactttgggaggccgagrcgggaggatcacgaggtcaggagattgagaccatcctggctaacacggtgaaaccccgtctctactaaaaatacaaaaaattagccaggcgtagtggtgggcgcctgtagtcccagctacttgggaggctgaggcaggagaatggcatgaacccgggagacggagtttgcagcgagctgagatggcgccactgcactccaccctgggcaacagagcaagactctgtctcaaaaaaaaaaaaaaaaggaaattagtcttttggttgtaaaagccttcctcactctaagattaaacatgatt

SEQ ID NO: 10444 - DNA, 601 bp, Human
tttctgtagagacagggattcaccatgttgcccaggctggtctcaaactcctgagctcaagtgatcccccggcctctgcctcccaagcgctgggattagagccgtaagacaccacgcccagcctaaggttatgtattttaagcagtggtagatactgccaagtcacactccacagagatcctatcagtttacgttcccacagcaatgtactaaagtgcatatcatcctacattcctgccaagtcagtgttgagatgaaactcttggatctttgcctattggtcagataaaattttcactgyagttttcacttacatttctcttattataagcaaaactgagcactgtcccgtatttttaaatatttcctatttccttttttgttaagggactgttggtatcctctgataatttttctactacattttaaatcttcttcttattgatttgtaagagctttttatatattaaggaaattagtcgccaggagcggtggctcacacctgtaatcccagcactttgggaggccgaggcgggaggatcacgaggtcaggagattgagaccatcctggctaacacggtgaaaccccgtctctactaaa

SEQ ID NO: 10445 - DNA, 601 bp, Human
acgacaataatggattgtaagctgtgacccggcaaatcaagcaaacatcggtgcacacttaaacagaggaggagcagcagctcttcatcacagcagaattccaatgaataaacacaaggaatggcagaaaacagaaagcacaccatcaggaaacaccacagcaataactggctggtgtaagttactactattttgagacagggtctcactctgttgcccaggctggatcacaatggcacaatcacagctcactgcagcctcgaccttcccgggctcaggtgatcctcccacctcagcctcytgagtagctgggactataggccgtgtattaccactcctagctaattttttttttctttttttttttgactgggtctcactctgtcgcccaggctgaagtgcagtagagtgatcttggctcacagcagcctcaaccctccggattcaagtgatcctcccacctcaaccttccgagtagctgagactacaggctcatgccaccatacccggctaatttttgtgttttctgtagagacagggattcaccatgttgcccaggctggtctcaaactcctgagctcaagtgatcccccggcctctg

SEQ ID NO: 10446 - DNA, 601 bp, Human
ctcttgtcacatggcaagctcttctctatgtgagtcctggctgtgtccagatttccctcttcttatacggataccaggaatactggagttaggccccacccccatgcagtgtgacctcatcacaacctgatacatctgaaatgacccaaataagctcacactcacaagtaccagggatgaggacgcgaacgtatctttctcttttttttttgagacagagtctcgctctgtcatccaggctggagtgcaggggcatgatctcagctcactgcaacctctgcctcctgggttcaggcgattstcctgcctcagcctccctagtagctgggattacaggcacgcaccaccatgcctggcttttatttttaaaagagacatggtttcaccatgttggccaggctggtctccaactcctgacctcaagtgatctgcccaccttggcctcccaaagtgctgggattacagacgtgagccaccatacctggcctctttttaaaaaagaataaaaatagagacaaggtttctctttgttgcccagcctggtcttgaactcctggactcaagtaaccctcccactttggcctcttaaagcactaggatg

SEQ ID NO: 10447 - DNA, 601 bp, Human
ataccaggaccctgccttggtcagtagatttgcaatacgtgatggtgtcaaggatatgtggccagccagccacgccgtgtcaaagtctaagcctaaatgaaccgcatctaactgggagcctctcctgttcttcacaaatttgtaacaagtagaaaggaaagacaacagaatatccaggaatcaaggttttaaaaatcagcatatcagccaggggtgcggtggctcacgcccgtaaacccagcactttgggaggctgaggtaggcggatcacatgaggtcaggagttcgagaccagcctggycaacatggagaaaccccatctgtactaaaaatacaaaagttagccgggcatggtggcaggcacctgtaatcccagctactcgggagactgaggcaggggaatggcttgaacttgggaagtggaggttgcagtgagccgagatcgtgccgctgcactacaggctgggtgacagagcaacattctgtctcaaaaaaaaaaaaaaattaacatatcaactttcatactcctaaaaggtacaaaaacttgccttttttttttttttttttttgagatgaagtctcactcttgttgcccaggctg

SEQ ID NO: 10448 - DNA, 601 bp, Human
tctgcgtgctgaacagtcgtcctgcctgcaagctccaggctgggtttcgcctggggcccaactgggctgtggtcctccgaggacacagaattggttttcctgaaaagacaaatatgcagaaagaatgagaattaggaagacacgagaaacaatatggtaattcgtcccatcaagggtgtctagcagaagctagcgtggacatctctaagtcgggctgttgctgaaagagaaatccacaggaccaaatgccacagtgtcagggtgtggttttggcaaggagccctcacagatgtcatcagtrtaagatactgtgtcttctcagaaccgcagaagcgaaactggagggggtgggctgctgccttcttttcagagggggtctcgctctgtcactgcgatcacagctcactgcagccccaacctcctggactcaggcaatgctcctgcctccgcctcacgagtagctgggaccacaggcacagaccaccatgcccccataattttttaaaaaattttttgtagaaatggggttttgctatgttgccaagactggtctcgaactcctgggctgaaaccatcttcccgccttggccttacaaagagc

SEQ ID NO: 10449 - DNA, 601 bp, Human; identical to SEQ ID NO: 3816

SEQ ID NO: 10450 - DNA, 601 bp, Human; identical to SEQ ID NO: 3817

SEQ ID NO: 10451 - DNA, 601 bp, Human; identical to SEQ ID NO: 3818

SEQ ID NO: 10452 - DNA, 601 bp, Human; identical to SEQ ID NO: 3819

SEQ ID NO: 10453 - DNA, 601 bp, Human; identical to SEQ ID NO: 3820

SEQ ID NO: 10454 - DNA, 601 bp, Human; identical to SEQ ID NO: 3821

SEQ ID NO: 10455 - DNA, 601 bp, Human; identical to SEQ ID NO: 3822

SEQ ID NO: 10456 - DNA, 601 bp, Human; identical to SEQ ID NO: 3823

SEQ ID NO: 10457 - DNA, 601 bp, Human; identical to SEQ ID NO: 3824

SEQ ID NO: 10458 - DNA, 601 bp, Human; identical to SEQ ID NO: 3825

SEQ ID NO: 10459 - DNA, 601 bp, Human; identical to SEQ ID NO: 3826

SEQ ID NO: 10460 - DNA, 601 bp, Human; identical to SEQ ID NO: 3827

SEQ ID NO: 10461 - DNA, 601 bp, Human; identical to SEQ ID NO: 3828

SEQ ID NO: 10462 - DNA, 601 bp, Human; identical to SEQ ID NO: 3829

SEQ ID NO: 10463 - DNA, 601 bp, Human; identical to SEQ ID NO: 3830

SEQ ID NO: 10464 - DNA, 601 bp, Human; identical to SEQ ID NO: 3831

SEQ ID NO: 10465 - DNA, 601 bp, Human; identical to SEQ ID NO: 3832

SEQ ID NO: 10466 - DNA, 601 bp, Human; identical to SEQ ID NO: 3833

SEQ ID NO: 10467 - DNA, 601 bp, Human; identical to SEQ ID NO: 3834

SEQ ID NO: 10468 - DNA, 601 bp, Human; identical to SEQ ID NO: 3835

SEQ ID NO: 10469 - DNA, 601 bp, Human; identical to SEQ ID NO: 3836

SEQ ID NO: 10470 - DNA, 601 bp, Human; identical to SEQ ID NO: 3837

SEQ ID NO: 10471 - DNA, 601 bp, Human; identical to SEQ ID NO: 3838

SEQ ID NO: 10472 - DNA, 601 bp, Human; identical to SEQ ID NO: 3839

SEQ ID NO: 10473 - DNA, 601 bp, Human; identical to SEQ ID NO: 3840

SEQ ID NO: 10474 - DNA, 601 bp, Human; identical to SEQ ID NO: 3841

SEQ ID NO: 10475 - DNA, 601 bp, Human; identical to SEQ ID NO: 3842

SEQ ID NO: 10476 - DNA, 601 bp, Human; identical to SEQ ID NO: 3843

SEQ ID NO: 10477 - DNA, 601 bp, Human; identical to SEQ ID NO: 3844

SEQ ID NO: 10478 - DNA, 601 bp, Human; identical to SEQ ID NO: 3845

SEQ ID NO: 10479 - DNA, 601 bp, Human; identical to SEQ ID NO: 3846

SEQ ID NO: 10480 - DNA, 601 bp, Human; identical to SEQ ID NO: 1295

SEQ ID NO: 10481 - DNA, 601 bp, Human; identical to SEQ ID NO: 1296

SEQ ID NO: 10482 - DNA, 601 bp, Human; identical to SEQ ID NO: 1297

SEQ ID NO: 10483 - DNA, 601 bp, Human; identical to SEQ ID NO: 1298

SEQ ID NO: 10484 - DNA, 601 bp, Human; identical to SEQ ID NO: 1299

SEQ ID NO: 10485 - DNA, 601 bp, Human; identical to SEQ ID NO: 1300

SEQ ID NO: 10486 - DNA, 601 bp, Human; identical to SEQ ID NO: 1301

SEQ ID NO: 10487 - DNA, 601 bp, Human; identical to SEQ ID NO: 1302

SEQ ID NO: 10488 - DNA, 601 bp, Human; identical to SEQ ID NO: 1588

SEQ ID NO: 10489 - DNA, 601 bp, Human; identical to SEQ ID NO: 1589

SEQ ID NO: 10490 - DNA, 601 bp, Human; identical to SEQ ID NO: 1590

SEQ ID NO: 10491 - DNA, 601 bp, Human
gtcagaaggtgatttttatttttctgtctgtgattttattttcagctatccagatagtgacacctcctgtagacaaggaagccgagtcgtatcaaggagaggaagaactagtttcccaaacagatgttaagacattcttggaagccttaccggtaggttcagtggtgtgctggtcaatgcttaacaaccggctccaccctccaacctcccctccctgccaccccaaaaaagaaaaagagagagaggccccggtttgtaccatttattgtaaatggtctcaccatggtgattgcaagtaaayaacatgatatcaaccagagtgcacattttctgaaaatttaacagttggctgacactagctgactagtgagagctagttagtttgagttctcgctagttagtttgagctgactccccacacccctgagttgctctgaaatggttcctctgttcttatctgtgggatgcaattagagccagctttagggacatataatctatggagcacagggcgtctgatagtaattccacagttcaagtacagagcttttgtttaatgctctgctgttactgctttgaaattcttaatgtattgaacaag

SEQ ID NO: 10492 - DNA, 601 bp, Human
cctcttgaaaactatcaaaagaagttgaaagatgattcagtgtggccaggctgtgggacattcactcattcattcattcattcctctctgacatagagacttgagaggtgtcaacagaggatgcaacattctcgggagaagaaaggcagattagaccttaaagcttttttctagtccctgttctggctgactttatcagccaagggaagaacaaatcaaggaaagccagggcctggaggggctgggcagagcctgctgctgtgtctgcattgcccctaatcccagaagactcactcaactsctggacaaaaccagaaggcagtctggccaggcccttgtctgcctcttagaagaaatctaggattctacaggaagggaacagtggcttatgaaaagaaaggcaggaagccttttggaaagtgaagctaagcctcctttgcatttgttcctgcagagctgggggaacagctcttccccaacaccttggtcaggtccccttgggggctttctgctgaaggctgacggctgagagtcatagggggaagggggtgatggtgaatggggaggagggtacagaaaagacagggtcttagactttgtt

SEQ ID NO: 10493 - DNA, 601 bp, Human
agaggtagtgcactcaaataccatttcattttgctttctccatatgacagcatcccctggagaagggtatagaggctgtccttggcatcttactccactatgtggacataccacagctttttcaatcacttcctattggtggacattaggctatttccagtccttagtgtaaataatgctgcaatgagtaagtacccttgagcatatgtcacactgtatttttgccagtgcgtctttgtgaaccttctcctttggatggagagagttggttctcttcccatttcctgccaatgaactttctttttttttttttttgagacagagtcttgctctgtcacccaggctggagtgcagttgcgcaatctcggcccactgcaacctctgcctcccaggttcaagtgattctcctgcctcagcctcctgagtagctgggattactggcatgcgctaccacacccggctaatttttttatttttagtagaggtggggtttcaccatgttagtcaggctggtctcgaactcctgacctcaggtgatccacctgccttggcctcccaaagtgctgggattacaggcatgagccaccgcaaccggcccaat

SEQ ID NO: 10494 - DNA, 601 bp, Human
tcctggcaaaataagcatgcaggtagtaatggtaggtatttctaatgtactttttacaacttagatcggtatggtagggatagacatatttgatatataccaaggaattcaaggtgacttggaagagaagctttataaataatgaataattcattttttattccaattcaaggcaagacattgaatgcatggattgtactaggcttttctatggcagtatggagagggctgggtggtttctgctctgaatgcctagtatagcagattctagggactgcaggcggctgttcttcctccaccyttcagaattaggccaccctctgtgcagcagaaacagcccccgcagggctgaagccttcaggccagtagtgacagcagaatgtgcagtctgggtgcgtgtcctctatggagtggttccagatgttgcttcagagggagagaagaagcaagaggagggacttgaggatggtgtgtttagttccctgaatccctgcccagaaaccataaccttaggaaaatattccagaatctgccatcaggttaaactgcttatgaacaaacaggctttggcgaagtctttctgtggtatgtaaagtttgtc

SEQ ID NO: 10495 - DNA, 601 bp, Human
ccagacaaagcaaaaaagaatgcgaagacacatcagtctctcccatcaggaagggcatggtggctgaatttgtctcaggagggccttgagagaagcataattctccagaattagatgcgaaaattatcagtgaagaaatctaagtgcttggggaagatatttggagtctgagtacctctctttctaggtaacagagccacaaatggtgcaccaagcctggtctccagggggatgcaaggagcatctgctaacactctaaactctgaaaccagcacaaaggtctggatggtttcttttattycttttttaataaaaaaattttttttccaaatttaatcaaaaggacggtttctttaggggctctctccctagggtccagccttcgatgattttaagggctccgagctgtttgtttcagacttgtttctccctctctctgtaattatctctgttcttcccacctttttctgtatcaatcagaagtgactgatccctttgactgtggaggaaatgctgttacactttgagtcatgcataccctttgggttatttctggagaggggtagtttcttttcttatccattgaagccacttgttttct

SEQ ID NO: 10496 - DNA, 601 bp, Human
cacttgttttctgcttggataaagatgtaccacgatttcaaggatgattttagctgcccagaggctctgctaaagccagctcagctaatttgcaatcacatgctgtttacaatagccttaaaaaataattgcacatgtttttaaattcctactgtgaatatatatatatattgaattttaaaaattgaatatacagccatctttatatacatatgaatatatatcagccatctttatatatatatgaatatatatgtgtatatatatactttatttataagtatactttatatatatatamttatatattaagtgtatatatatatatacacacactcatatatatattcacatatatataaagatggcggtctcactgtgttgcccaggcttgtcctgaactctcaggctcaaggaattctcctgcctcagccacccaagtaccaccatgccagcttgtatattatttttatattcagaaataaaattacaaaagatttcccttttttgaaggcattagatcactccagaaatgaaccatctgaaaaaaatctttgatatttatgttgtctcatgaaatccttgtgtatgctttcttcat

SEQ ID NO: 10497 - DNA, 601 bp, Human; identical to SEQ ID NO: 1591

SEQ ID NO: 10498 - DNA, 601 bp, Human; identical to SEQ ID NO: 1592

SEQ ID NO: 10499 - DNA, 601 bp, Human; identical to SEQ ID NO: 1593

SEQ ID NO: 10500 - DNA, 601 bp, Human; identical to SEQ ID NO: 1594

SEQ ID NO: 10501 - DNA, 601 bp, Human; identical to SEQ ID NO: 1595

SEQ ID NO: 10502 - DNA, 601 bp, Human; identical to SEQ ID NO: 1596

SEQ ID NO: 10503 - DNA, 601 bp, Human; identical to SEQ ID NO: 1597

SEQ ID NO: 10504 - DNA, 601 bp, Human; identical to SEQ ID NO: 1598

SEQ ID NO: 10505 - DNA, 601 bp, Human; identical to SEQ ID NO: 1599

SEQ ID NO: 10506 - DNA, 601 bp, Human; identical to SEQ ID NO: 1600

SEQ ID NO: 10507 - DNA, 601 bp, Human; identical to SEQ ID NO: 1601

SEQ ID NO: 10508 - DNA, 601 bp, Human
aaggcgtacctttctgccaaagggaagaacactgttctttgaaaccaaaagccacttccagtctggtctgtggcctggacttacaaagaaaggcatcactcccccatgccaattcttgcatacacactggaaaaaaacaattgctctgttcttacctggagagtctgtgccttgagtcatggaggaatccagtcgggtcagattcactagcagagccaccacccaggggacccacccagaacccattctggagaaaggaaaaaaatgagatagtaaaatcgtcagcctcttcagaatgagytcataaaattcagtcagaaagtacccattaagagtataaatcgctgtttttctggcttccccaggattggaaactcctcagattgacaaccaatcaagatagaagagttttgcatcatcaggtactgggtaggatactttcacaaagttgtgtcatacaactcaaccattgtttgcctgcagaatcactgacagtaatttaggtatactaaaaatgggctgggagaagaagtaaaaatatatgtttgacatattatggggccctagaagaactaggcagactgtttattatgtattcttc

SEQ ID NO: 10509 - DNA, 601 bp, Human
gtatatgaagtccatcccatgtaaagaggcaaggcgtacctttctgccaaagggaagaacactgttctttgaaaccaaaagccacttccagtctggtctgtggcctggacttacaaagaaaggcatcactcccccatgccaattcttgcatacacactggaaaaaaacaattgctctgttcttacctggagagtctgtgccttgagtcatggaggaatccagtcgggtcagattcactagcagagccaccacccaggggacccacccagaacccattctggagaaaggaaaaaaatgagayagtaaaatcgtcagcctcttcagaatgagctcataaaattcagtcagaaagtacccattaagagtataaatcgctgtttttctggcttccccaggattggaaactcctcagattgacaaccaatcaagatagaagagttttgcatcatcaggtactgggtaggatactttcacaaagttgtgtcatacaactcaaccattgtttgcctgcagaatcactgacagtaatttaggtatactaaaaatgggctgggagaagaagtaaaaatatatgtttgacatattatggggccctagaaga

SEQ ID NO: 10510 - DNA, 601 bp, Human; identical to SEQ ID NO: 1918

SEQ ID NO: 10511 - DNA, 601 bp, Human; identical to SEQ ID NO: 1919

SEQ ID NO: 10512 - DNA, 601 bp, Human; identical to SEQ ID NO: 1920

SEQ ID NO: 10513 - DNA, 601 bp, Human; identical to SEQ ID NO: 1921

SEQ ID NO: 10514 - DNA, 601 bp, Human; identical to SEQ ID NO: 1922

SEQ ID NO: 10515 - DNA, 601 bp, Human; identical to SEQ ID NO: 1923

SEQ ID NO: 10516 - DNA, 601 bp, Human; identical to SEQ ID NO: 1924

SEQ ID NO: 10517 - DNA, 601 bp, Human; identical to SEQ ID NO: 2294

SEQ ID NO: 10518 - DNA, 601 bp, Human; identical to SEQ ID NO: 2295

SEQ ID NO: 10519 - DNA, 601 bp, Human; identical to SEQ ID NO: 2296

SEQ ID NO: 10520 - DNA, 601 bp, Human; identical to SEQ ID NO: 2297

SEQ ID NO: 10521 - DNA, 601 bp, Human; identical to SEQ ID NO: 2298

SEQ ID NO: 10522 - DNA, 601 bp, Human; identical to SEQ ID NO: 2299

SEQ ID NO: 10523 - DNA, 601 bp, Human; identical to SEQ ID NO: 2300

SEQ ID NO: 10524 - DNA, 601 bp, Human
caccagctccagagcccccgacgccccctgcaaggctgtcctcagcctccgtgagtgctcgggcccaaccccaggctggagtgggagcgtcagaccacgccccccacagagggcctcaaagtcgaggaagctggggcaggtccctgaggaggagctatggagtccctgggccagggtccacgtggtccccaggtggccccacagcaactacggccacccagcagccaccttgatggccccaggaaggagggaagctcagggtcaagtggacgctacaggccttgcctgcgggatcccacgrcagctcccgcggcccccaggcctcaccttgaacccgataccgcccttcttacagcacaggcaggccagcatgaggacgatgacggcgaagagcccggagaaagacacagccaccacggcgagggaggatggccaggacagctcgctgagcggggcgccgtctgcgggagagcagtgtggtgagagtggccatggctgagggccggccaggcccctgcccctgctctgggctccacagccccacctggacttgctgcattccaggctgggcctcagcaccctgacctctcaccccagaccc

SEQ ID NO: 10525 - DNA, 601 bp, Human
ggggccttggcctccagaggggcagcctagtgaggccaggcctcacccttggcggggctccctaaccagcaggctgggctctagcatcacacatcgtcccctccagaaggcagaagataccccgcgcaaggtgactccaactggcaagaaggtccctgtgccgggaagcttgtctgggcagcccggactcccctttgcagattgaattcggagggacgtgagagccccttgcagaggcagctcctccaccaggagtcgggcctctagggaggcaagccccctcccacaccagctccagagmccccgacgccccctgcaaggctgtcctcagcctccgtgagtgctcgggcccaaccccaggctggagtgggagcgtcagaccacgccccccacagagggcctcaaagtcgaggaagctggggcaggtccctgaggaggagctatggagtccctgggccagggtccacgtggtccccaggtggccccacagcaactacggccacccagcagccaccttgatggccccaggaaggagggaagctcagggtcaagtggacgctacaggccttgcctgcgggatcccacggcagctcccgcggcc

SEQ ID NO: 10526 - DNA, 601 bp, Human
tgcctggccctccctgctgctcagagttacagctggaggtgggctgggggtttgcagggggaggagcagtgcttggcacctgtccttggccaggggccttggcctccagaggggcagcctagtgaggccaggcctcacccttggcggggctccctaaccagcaggctgggctctagcatcacacatcgtcccctccagaaggcagaagataccccgcgcaaggtgactccaactggcaagaaggtccctgtgccgggaagcttgtctgggcagcccggactcccctttgcagattgaattyggagggacgtgagagccccttgcagaggcagctcctccaccaggagtcgggcctctagggaggcaagccccctcccacaccagctccagagcccccgacgccccctgcaaggctgtcctcagcctccgtgagtgctcgggcccaaccccaggctggagtgggagcgtcagaccacgccccccacagagggcctcaaagtcgaggaagctggggcaggtccctgaggaggagctatggagtccctgggccagggtccacgtggtccccaggtggccccacagcaactacggccacccagca

SEQ ID NO: 10527 - DNA, 601 bp, Human
gggacgcaggtgctgcgtgggcaacttcccctccccgggacccagaagaccaccccagaagccccctcttgggccctccaatcccagccccggcctggccccacccatctgggctttgtagaggggcccaggacacagatgctgtctctccctggggtcgggcccgggctccaggcattacctgctgcccgggggccagccgggtcctgccgatacagcgtgcaatcaggtagcacagggtcagcattgggggcctgcccagccccttccctcagcacagctccccaccagggagcccagygcaggtccccaaatcccaggagggagcccagtgtggaggcaggacttcccaggggcacactggtgctggaatgttccgggcaccatgttcccaaggaggtgaggagggcgcaggaggaggagctatggccagcccttgtttggggccttgttcttacagtgccccaaggaggggccacttatacaatagccccactcgtcccacccaggccccacctccactcctgctcccgccaagaccttgaggctctggcctcgggatccccaggaaggcgcctgcgcggcctggcctggcccctgg

SEQ ID NO: 10528 - DNA, 601 bp, Human
ccaccgccatctgccccagcagccttggaccttcacctggtggccacaccacctccggagctcccagaactccttaagagcctggccccgtgcagcctagggctgggccactccctgccaggctgctattttgaaatgtagaggccgcacctgtataggggataccccacccccaagtccagggcacattcctgcgctgagagccaaagtctccaaagtcctgggcccagctgaaagcaattgctccaggcacacaatgacagccccaatccctgagcacttggtacagcctttctgtccytcctcacaacccccagtgccctggtggggaagctgaggctcagaggagtcaagggacttccagctggatgctggccagcacccgggctggtgagtccgaggacaggcaggtgcagtgggaggggaggcctgggctcctcaagtactacgtgtgaccctggggacgcctcccttccctgggctgcaaagagaggggcaggtggctctgtcggtattcccgcaggccaggcccagcctgccctttcggagcacacagccactcagggatgggggacgcaggtgctgcgtgggcaacttcccc

SEQ ID NO: 10529 - DNA, 601 bp, Human
gaagagcccctgcccccagcacatggccatgtccaggaccagagagcccgcacccctgccccagtgcccacccctgccccgtgcccacccctgtccctgtgcatagcagccccttgggcaggggaggctggaggccgagggctgtcctggaccctgccaacccctggccggcccccaggcccaggagaaagaggtacatgcacctttggccccacagtgcggcctgtgacgcagccacagggagtccagggctgcacactgcgtctaccccacaggccactcccagccctgtgctgccccyactccagagctgagtcttccggtctccccagatcacacccaacgcccagcacctgggccccggagggaggccaccccatctccccacccagccctcacctgagcgcccaggctgcttggccatgggcaaggagacctccgtgagtggcaggacgtacacgtcgggcccgttctgtgctgccgtggccggggagccctgcgccaggtcggctgcgtactcgtccccctccgcattctcaaactcctgcgggccgggccgggcatgagcggggcttctcgcaggtcaaggaagggtgtggct

SEQ ID NO: 10530 - DNA, 601 bp, Human
gtccgagggcctcacgctctgagtgggtggctgcagtcctccgcgcccgcccacagatgtactcgagctcaagtgccagccctgattcctgccgaactgggaacctgtcctccaggagatggggcagagtaggacaggcgttgaggccttggctccaaagctgggggctgggggccctctctaggtcccagaccagtgccttgggcctctcagcccacgatgaaggctaggctctcagggcccagccaggcacagttcatagccagctctcagggtccagccaggcacggctcagagcagstgaggtggcctgcatggcaccgcagtaacaggccctggtgccaacagagccccaacagggctggcaggggcccctcccactggcctgatacccctcctgcctctgtgttcccagaggagctgggggtgggcagtgatgggggaagcctcaggctggaagcttcctgggagggggcttgagatctgatagctctggagggacccgcacccaccacctaggctccaagacagaactgggaggtcctgaagcctggccattcacccccaaactccccagcacgtccgccccatgtgagtggtc

SEQ ID NO: 10531 - DNA, 601 bp, Human
agcgctggcagagcccactcatgcctgcccacgccccgagggattccccgaattctgctcccacgtcaactgcccagagggctgacaggcctgggtctgagcctggctgccaggagagcccagggggagggggctccttccagggcctggagacccagagaatgtagaggcggggcagggcagaattgagcgtgtgggcccaccgggtgctgtgtcctgagcccagcctgtctgggcggccctctctcaccctggggcgcccaggcccacactgtccctgagcaagtgtgggggtcctgaycatgggtgctgagacagttcagaggccctgggcactgccggaggcagcaggcagccgtccttctctgcggtccccagcgggtggggccattgcccaggtttctccccgctgacctctggggctacttttctgacctcaccccaatctctctcctccctagaagcacattcctcccccagaaaactgaaaccagagctgcaaaagtagagagacaggtaaccagtgccttctttcgggctcctgttcgccaaccccagtccccacagcaatcctccagaggtggctctgagaatcttcggg

SEQ ID NO: 10532 - DNA, 601 bp, Human; identical to SEQ ID NO: 3215

SEQ ID NO: 10533 - DNA, 601 bp, Human; identical to SEQ ID NO: 3216

SEQ ID NO: 10534 - DNA, 601 bp, Human; identical to SEQ ID NO: 3217

SEQ ID NO: 10535 - DNA, 601 bp, Human
ctaaataaaatcattccataaaggctaattcctaatatttattctcaagtaaacacactaagatgactggcttccaccaacatgccagccatctagatatgttttgaatcattatgcaacaaactcaattcacaagctcaggtcttttggagttcttataccaaagatcagaaaactatagatgaatcctaactggtctccaaacaaaagggaaggaaagtcttgtttccccaaaacaggattagcattccacagtatcaagaaacccagtttatcttattgtctcataaacttggatttstcatcactctgccctgatggggaagaggcagcttacagaatctgcacaggatttttatgtatagtgaattagtgtgttgtggtgttggcctccttctcaccctcaccctcgcagcattccttcccttcttcctcccctcccccacctacatacctctttggagcaccaggcacattttgggtggattagcagacattcttcacatgaggtggcacttccactagtgcatatgttgagacctttaaagcaagataaagatgcactaattagttcctggctataaacttcatggatcaagcc

SEQ ID NO: 10536 - DNA, 601 bp, Human
ctcaagcctcaagcaatcctcctgccttggcctcccacaatgctggcatgagccacagtacccagcccatattgctttatgataccaatagcctaacattgtcccaaacctatatctctttctaaaaggcttaaagaaatggcagccattatttctaaataaaatcattccataaaggctaattcctaatatttattctcaagtaaacacactaagatgactggcttccaccaacatgccagccatctagatatgttttgaatcattatgcaacaaactcaattcacaagctcaggtcttytggagttcttataccaaagatcagaaaactatagatgaatcctaactggtctccaaacaaaagggaaggaaagtcttgtttccccaaaacaggattagcattccacagtatcaagaaacccagtttatcttattgtctcataaacttggatttgtcatcactctgccctgatggggaagaggcagcttacagaatctgcacaggatttttatgtatagtgaattagtgtgttgtggtgttggcctccttctcaccctcaccctcgcagcattccttcccttcttcctcccctcccccacc

SEQ ID NO: 10537 - DNA, 601 bp, Human
ttccctccttccttcctccctccctctctctttctttctttcctgatttatttagtagagatagaatctcgctatgttgtctaggctggactcaaactcctgagctcaagcctcaagcaatcctcctgccttggcctcccacaatgctggcatgagccacagtacccagcccatattgctttatgataccaatagcctaacattgtcccaaacctatatctctttctaaaaggcttaaagaaatggcagccattatttctaaataaaatcattccataaaggctaattcctaatatttattctcaagtaaacacactaagatgactggcttccaccaacatgccagccatctagatatgttttgaatcattatgcaacaaactcaattcacaagctcaggtcttttggagttcttataccaaagatcagaaaactatagatgaatcctaactggtctccaaacaaaagggaaggaaagtcttgtttccccaaaacaggattagcattccacagtatcaagaaacccagtttatcttattgtctcataaacttggatttgtcatcactctgccctgatggggaagaggcagcttacagaatc

SEQ ID NO: 10538 - DNA, 601 bp, Human
cagaggtcagattaaaaccccagctttggcacacttgtgtgaccttgagtgagttattttactgctctgagtctgagattttcatcaataaaacaagtgtattacacccacctgacagagctattgtgaggatcagagatattgtatgatgtacaaagtgtatgacatctagtagagtccccacatgatcatttttagccatcataggttaaaggaatccctagacctctgaggctgccatgatggagactaaccccagcctcccgtgagccatctcttggtcctcctgacagggaccacrcactgcattgcagactgagccagtcaaaaagtcctggattcctttacaaataaccttaatggggcacttttacagggagggtttgtgacccagaaatttccttcaagagaggaaatttagaaatcgatcattttctgattagtccaccaagttacatttccttccctccttccttcctccctccctctctctttctttctttcctgatttatttagtagagatagaatctcgctatgttgtctaggctggactcaaactcctgagctcaagcctcaagcaatcctcctgccttggcctcc

SEQ ID NO: 10539 - DNA, 601 bp, Human
ctgttgcccaggctggagtgcaatggcctgatctcaggtcactgcaacctccacctcccaggttcaagcaattctcctgcctcagcctcccaagtagctgggattacaggtgcatgacaccacgcctggctaattttttgtatctttaatacagatggggtttcaccatattggccaggctggtctcgaactcctgaccttgtgatccacccgtctcagcctcccaaagtactaggattacaggcgtgagccaccgcgcctggccgaattgattcttaaaaacgataaaacaaggtatcartcaaggaaaggaggggccgggcatggtggctcacatctgtaatcccagcactttgggaggccaaggcaagagaatcatttgaggtcaggtgtttcagacaagactgggaaacatagagagatcccacctctaaaagattttttttcaattagccgagcacagtggcccacacctgtagtcccagctacctggtggctgaggtaggaggactgcttgagcccaggagatggaggctgtagtgagctatgatcacatcactgtattccagcctgggtgacagagcaagatcctgtctcaaaa

SEQ ID NO: 10540 - DNA, 601 bp, Human
cctgttgcccaggctggagtgcaatggcctgatctcaggtcactgcaacctccacctcccaggttcaagcaattctcctgcctcagcctcccaagtagctgggattacaggtgcatgacaccacgcctggctaattttttgtatctttaatacagatggggtttcaccatattggccaggctggtctcgaactcctgaccttgtgatccacccgtctcagcctcccaaagtactaggattacaggcgtgagccaccgcgcctggccgaattgattcttaaaaacgataaaacaaggtatcmgtcaaggaaaggaggggccgggcatggtggctcacatctgtaatcccagcactttgggaggccaaggcaagagaatcatttgaggtcaggtgtttcagacaagactgggaaacatagagagatcccacctctaaaagattttttttcaattagccgagcacagtggcccacacctgtagtcccagctacctggtggctgaggtaggaggactgcttgagcccaggagatggaggctgtagtgagctatgatcacatcactgtattccagcctgggtgacagagcaagatcctgtctcaaa

SEQ ID NO: 10541 - DNA, 601 bp, Human
caggcctgaattgattctttttttttgagacagagtctcgccctgttgcccaggctggagtgcaatggcctgatctcaggtcactgcaacctccacctcccaggttcaagcaattctcctgcctcagcctcccaagtagctgggattacaggtgcatgacaccacgcctggctaattttttgtatctttaatacagatggggtttcaccatattggccaggctggtctcgaactcctgaccttgtgatccacccgtctcagcctcccaaagtactaggattacaggcgtgagccaccgcgsctggccgaattgattcttaaaaacgataaaacaaggtatcagtcaaggaaaggaggggccgggcatggtggctcacatctgtaatcccagcactttgggaggccaaggcaagagaatcatttgaggtcaggtgtttcagacaagactgggaaacatagagagatcccacctctaaaagattttttttcaattagccgagcacagtggcccacacctgtagtcccagctacctggtggctgaggtaggaggactgcttgagcccaggagatggaggctgtagtgagctatgatcacatcac

SEQ ID NO: 10542 - DNA, 601 bp, Human
catgccactgcactccaacctgggctacagaatgagaccccatctcaaaagaaaaaaaaaaaaaaaaaccccagtggagggagcttacattctcatatcaaatggatacacagataaatagacagatggatggatggataaatgaatggatagacagatggagacagtcaggtatgcaggtcgttatggagtagatgaggttaaactgattaatttttttttcttttttgagacagggtcttgctttgtcgcccaggctggagtgcagtggcacaatcttggctcactacagctcctcctmccgggctcaagtgatcctcccacctcagccccccaagtagctgggactacaggcatgcactagcacacccagctaattttttgtattttttgtagagacggggtttcgtcatgttgcccaggccggtcttgaacttctgagctcaagcaatccactcacctcagcttcccaaagtgctgggattacaggtgtgagccactgcacaccaggcctgaattgattctttttttttgagacagagtctcgccctgttgcccaggctggagtgcaatggcctgatctcaggtcactgcaacctcc

SEQ ID NO: 10543 - DNA, 601 bp, Human
gagcagctactatgtggtaagcgccattcaggaatacagcaatgaagaaaacagatagaacccctgccccagtcgggcatggtggatcacacctataatcccagcactttgggaggccaaggtgggtggatcacgaggtcaggagttcaagaccagcctggccaagacggtgaaaccccgtctctactaaaaatacaaaaactagccgggtgtggtgccacgtgcctgtaatcccagctactcaggaggctgaggcagagaattgcttaaacccaggaggtggaggtggcagtgagccgasatcatgccactgcactccaacctgggctacagaatgagaccccatctcaaaagaaaaaaaaaaaaaaaaaccccagtggagggagcttacattctcatatcaaatggatacacagataaatagacagatggatggatggataaatgaatggatagacagatggagacagtcaggtatgcaggtcgttatggagtagatgaggttaaactgattaatttttttttcttttttgagacagggtcttgctttgtcgcccaggctggagtgcagtggcacaatcttggctcactacagctcctc

SEQ ID NO: 10544 - DNA, 601 bp, Human
tcctttgagcagctactatgtggtaagcgccattcaggaatacagcaatgaagaaaacagatagaacccctgccccagtcgggcatggtggatcacacctataatcccagcactttgggaggccaaggtgggtggatcacgaggtcaggagttcaagaccagcctggccaagacggtgaaaccccgtctctactaaaaatacaaaaactagccgggtgtggtgccacgtgcctgtaatcccagctactcaggaggctgaggcagagaattgcttaaacccaggaggtggaggtggcagtgmgccgacatcatgccactgcactccaacctgggctacagaatgagaccccatctcaaaagaaaaaaaaaaaaaaaaaccccagtggagggagcttacattctcatatcaaatggatacacagataaatagacagatggatggatggataaatgaatggatagacagatggagacagtcaggtatgcaggtcgttatggagtagatgaggttaaactgattaatttttttttcttttttgagacagggtcttgctttgtcgcccaggctggagtgcagtggcacaatcttggctcactacag

SEQ ID NO: 10545 - DNA, 601 bp, Human
acagtactcttatatcaaatacaaattcctgccagattcttggctggatactgggtatccaagataagacagtttagtttctcaaggagatgatgatttagttggtaacaggcatgaaaacaaattaaaacaaaaagaggttataaatactaaagaagcacagagtacacggagacaaagaggtagtcatggcctgcacctagcagacacacaataaatagccatccagtgaaatcctttgagcagctactatgtggtaagcgccattcaggaatacagcaatgaagaaaacagatagaamccctgccccagtcgggcatggtggatcacacctataatcccagcactttgggaggccaaggtgggtggatcacgaggtcaggagttcaagaccagcctggccaagacggtgaaaccccgtctctactaaaaatacaaaaactagccgggtgtggtgccacgtgcctgtaatcccagctactcaggaggctgaggcagagaattgcttaaacccaggaggtggaggtggcagtgagccgacatcatgccactgcactccaacctgggctacagaatgagaccccatctcaaaagaaaaaaa

SEQ ID NO: 10546 - DNA, 601 bp, Human
taaatcacagcaaaactgattgaaactttggtttttctaacttcatgtctttttaacagtactcttatatcaaatacaaattcctgccagattcttggctggatactgggtatccaagataagacagtttagtttctcaaggagatgatgatttagttggtaacaggcatgaaaacaaattaaaacaaaaagaggttataaatactaaagaagcacagagtacacggagacaaagaggtagtcatggcctgcacctagcagacacacaataaatagccatccagtgaaatcctttgagcarctactatgtggtaagcgccattcaggaatacagcaatgaagaaaacagatagaacccctgccccagtcgggcatggtggatcacacctataatcccagcactttgggaggccaaggtgggtggatcacgaggtcaggagttcaagaccagcctggccaagacggtgaaaccccgtctctactaaaaatacaaaaactagccgggtgtggtgccacgtgcctgtaatcccagctactcaggaggctgaggcagagaattgcttaaacccaggaggtggaggtggcagtgagccgacatcat

SEQ ID NO: 10547 - DNA, 601 bp, Human
tataattcccataatcctcacatatcaagggagaaaccaagtggaggtaactgaatcatgggggcggtttcccctatgctgttctcttgatggtgagtgagttctcctgagatctgatagtttcataaggggctcttccccctttgctcagcacttctccttcctgacaccttgtgaagaaggtgcattgcttccccttcaccttccaccacggttgtaagtttcctgaggcctccccagccatggcgaactgtgagtcaattcaacccctttcctttataaattacccagtcttgggtayttccttatagcaatgtgagaacagactaatacatgtgtcttaagctgtgctgtacaaacagcaccataagggctgagaagcaggcggccaaggctgtctagaacaaggtagagagtgtgctgcagagaggcaggggcagcatggacaggccaagacaggcagtgacccatacatcctggtctcagagtaggggagagtctggcgactctggatatgagggcagaaagtaagtctgaaaccctcaggtaaagcatggtgagaaaatgaaggcaagaggccaggcacagtggctcactgtct

SEQ ID NO: 10548 - DNA, 601 bp, Human
ctcactgcaacttctgcctcctggggtcaagtgattctcatgcctcagcctcccgaatagctgggactgctatgcctggctaatttttgtatttttagtagagatggggtttcaccatgttggccaggctggtcttgaactcctgagttcaagtgatccacccgcttcagcctcccaaagtgctgggattacaggcatgagccaccatgcccagctccctacatattttttgctaatcaaggtctcttaccctgcagtcaaagctagtgttcaatgggtgcttggctgtccagcatcacarccagtgcattcaggttcctctatgccagaccagacattacattatttgagtgccatcctgcctaccattgctgaaggctaaaactctaaaaaggtgagggtgattgttttgggggaaaagacaaattcttgtttgtttctgaaacagagtagaagagttgagaaactgtaggcccttgaacaaaaggaacccaagcaagaaaggaggccagcatgcccaatccctgggatgaagagggaagaaaacaaactgggaaaaaggcagagagcccaggggagaagtggacacaggcggggagct

SEQ ID NO: 10549 - DNA, 601 bp, Human
gttacatggaggataagatgaggtctgctacttattataatatgttaacacctgactccatatatattttgtttgtttgtttttgagatggaatctcgctctgtcacctaggctggagtgcagtggtatgatctcggctcactgcaacttctgcctcctggggtcaagtgattctcatgcctcagcctcccgaatagctgggactgctatgcctggctaatttttgtatttttagtagagatggggtttcaccatgttggccaggctggtcttgaactcctgagttcaagtgatccacccrcttcagcctcccaaagtgctgggattacaggcatgagccaccatgcccagctccctacatattttttgctaatcaaggtctcttaccctgcagtcaaagctagtgttcaatgggtgcttggctgtccagcatcacagccagtgcattcaggttcctctatgccagaccagacattacattatttgagtgccatcctgcctaccattgctgaaggctaaaactctaaaaaggtgagggtgattgttttgggggaaaagacaaattcttgtttgtttctgaaacagagtagaagagttgaga

SEQ ID NO: 10550 - DNA, 601 bp, Human
aacttcctaggctcaagctgtctccccacctcagcctcccaagtagctgggactacaggcaggtgccaccacatcccactgattttttactttttttgtagagaccaggtctcactatgttgcccaggctggtctacaactcctgggctcaagcaatcctctcgcctcagcctcccaaagtgctgggattataggcgtgagccaccatgcctggccttttgctgcttttagttactaagtggtaataatataaaagagaaaagagaggtgtttaaaatttagattgtttttagtttgttayaacactggtgtttgcaacttattgtaagccaccatgctcactcaccccatcatcactgttacatggaggataagatgaggtctgctacttattataatatgttaacacctgactccatatatattttgtttgtttgtttttgagatggaatctcgctctgtcacctaggctggagtgcagtggtatgatctcggctcactgcaacttctgcctcctggggtcaagtgattctcatgcctcagcctcccgaatagctgggactgctatgcctggctaatttttgtatttttagtagagatg

SEQ ID NO: 10551 - DNA, 601 bp, Human
cctcaatacctatatttctaagctccatattcaatgaatacggatgcctcatatcataaagccttagagaaaaggcagactgatgtttaagaaaatcctccttcctaagcaaattaatgcaggaacagaaaaccaaataccacgttttcccttatcagtgggacctaaacattgagcacccacagacataaacatgggaacaacagatactgtgaactactgggacaggagagtttatgggtcgaaaaactacttaatgggtactacgctcactacttagagtgcaatatacccatataasaaacctgcacatataccctctgtatctaacatgaaagttgaaaaaaaaaagaaaaagaaagtcctcctcacatgaatgacatcctgatgtctgatggcgtaacagtttcagatcccagagacctgacactcagaccctctgccaggtgtcagacatagcaagttccaaggggaagggcccttgactgcatcacctggtgccatcccctggcttccacaggtggggaatcagaggtccacagacctaagttcacccaagaagttgaagttcatctggccctggcttcttgggcccaaatcc

SEQ ID NO: 10552 - DNA, 601 bp, Human
aagaaaagaaaaaagaaaaagaaagaaagaaagaaagaaaaaatgtctcaagacctatatttctttttttttttttttttttttttttttgagatggagtcttgctctgtcatccaggctggagtgcagtgacacgatctcagctcactgcaaggtccgcctcccggttcaagccattctcctgcctcagcctctggagtagctgggactacaggtgcccgccaccacgcccagctaattttttgtatttttagtagagacagggtttcaccgtgtttgctagaatagtctcgatctcctracctcatgatccacccgcctcagcctcccaaagtgctgggattacaggtgtgagccaccacatccggcccctcaatacctatatttctaagctccatattcaatgaatacggatgcctcatatcataaagccttagagaaaaggcagactgatgtttaagaaaatcctccttcctaagcaaattaatgcaggaacagaaaaccaaataccacgttttcccttatcagtgggacctaaacattgagcacccacagacataaacatgggaacaacagatactgtgaactactgggacaggag

SEQ ID NO: 10553 - DNA, 601 bp, Human
aaaaaagaaagagagagagaggagaaagaaagaagaaagaaagaaagaaaagaaaaaagaaaaagaaagaaagaaagaaagaaaaaatgtctcaagacctatatttctttttttttttttttttttttttttttgagatggagtcttgctctgtcatccaggctggagtgcagtgacacgatctcagctcactgcaaggtccgcctcccggttcaagccattctcctgcctcagcctctggagtagctgggactacaggtgcccgccaccacgcccagctaattttttgtatttttagtasagacagggtttcaccgtgtttgctagaatagtctcgatctcctgacctcatgatccacccgcctcagcctcccaaagtgctgggattacaggtgtgagccaccacatccggcccctcaatacctatatttctaagctccatattcaatgaatacggatgcctcatatcataaagccttagagaaaaggcagactgatgtttaagaaaatcctccttcctaagcaaattaatgcaggaacagaaaaccaaataccacgttttcccttatcagtgggacctaaacattgagcacccacagac

SEQ ID NO: 10554 - DNA, 601 bp, Human
gttcttgttgcccaagaaaaggaactgagagtgctgcggactcaacagagggagttaggtcacaagccaagagcttcgcctctattccatgtgttcctttctaagtatttttattttcatttttgagacggagtctcactctgtcacccaggctggagtgcagtggtgtaatctcagctcactgcaacctctgcttcctgggttcaagtgatcccgccaccttagcctccggagtagctgggattacaagcatgtgctactatgcctggctaatttttgtatttttagtagagacagtgtwttgccatgttgaccaggctggtcttgaactcctgacctcagatgatcgccatggccgcccaaaatgctgggcttacaggcataagccacaacacctggcctagatattttaattttgaacaaggatagatgcatatttaaagagagaaaaccaaaatgacagagaccaggggcatatctagtaatggctatgaccttccaggtatacaaacattataaatctggaaaatgtctcttaacccttagtagtttaaggtaaaaaaagaaaaaaaaagaaaaaaaagaaagagagagagaggag

SEQ ID NO: 10555 - DNA, 601 bp, Human
cgagtcctgtcattattttcccagagctctagggactcagagccactagctgaggcaccacggggcaaggcaggtctgaagaagcttttgagggtaaggcagctaccttaacagggaaattcccctaagaggtaaagatctcttttggcacggagtccaaacaattgctgtgactaatttcttttgatttatttttgacccgataaggaaagagtaagccataactgatttgtagctataggttcttgttgcccaagaaaaggaactgagagtgctgcggactcaacagagggagttaggycacaagccaagagcttcgcctctattccatgtgttcctttctaagtatttttattttcatttttgagacggagtctcactctgtcacccaggctggagtgcagtggtgtaatctcagctcactgcaacctctgcttcctgggttcaagtgatcccgccaccttagcctccggagtagctgggattacaagcatgtgctactatgcctggctaatttttgtatttttagtagagacagtgttttgccatgttgaccaggctggtcttgaactcctgacctcagatgatcgccatggccgcc

SEQ ID NO: 10556 - DNA, 601 bp, Human
aattacaggcgtgagccagtgcacccggcctctggccttagatttaaaagcagaactttctaaatggggttccaggtggtcaagcttggctctgatatagcagttctagtgaagcagtgagaagaaaaacacagggttctggaaaaggaggggtaacgacctgagggccctgccagtttgggtctgctgtcttgagctgtctgaagtagatgtctaattagctttccagagcttgaagagctcaggggcttgcctgcccagtgcttactctgctagagaatttctgaatttctcactggcraactgagccttgctatccagcccctctgcttctgaggaactgactatacttggcccagttctgtttgtcaaggtgcacctgttttgatcagtccagtgcacagccccaccaccagggtggcaacggaagcatggtcagttttttcagagtaatgagaacccctgacacctctctcactggtctggaccagcttacactctggaatagactagggcacagagccaacctgcttcacctaagcaggaggcaggtgcacaattccttcagtttggtcaatgagatgatcccccccactgctgg

SEQ ID NO: 10557 - DNA, 601 bp, Human
atatatatattattctggccttagatttttttttttttttttagacacagtcttgctctgtcaccagactggagtacagtggcgcaatctcagctcactgcaacctccgactccctggttcaagcaattctcctgcctcagcctcccgagtagctgggattacagccacgcaccaccatgcccagctaatttttgtatttttagtagagacgggctttcaccatgttggccaggatggcctcgatctcctgaccttatgatctgcccgcctcggcctcccaaaatgctggaattacaggcrtgagccagtgcacccggcctctggccttagatttaaaagcagaactttctaaatggggttccaggtggtcaagcttggctctgatatagcagttctagtgaagcagtgagaagaaaaacacagggttctggaaaaggaggggtaacgacctgagggccctgccagtttgggtctgctgtcttgagctgtctgaagtagatgtctaattagctttccagagcttgaagagctcaggggcttgcctgcccagtgcttactctgctagagaatttctgaatttctcactggcgaactgagcct

SEQ ID NO: 10558 - DNA, 601 bp, Human
gtcctggaactacccaatgccctttagaatccttataaaattcaagatcaagaagtcagcctggtgtggtggctcacacctgtaatcccagcactttgagagacttgaggcaggaggatcatttgggctgggagttcaacgctgcagtgaactgcgattgtgccactgcactcctgcctgggcgacagagcaagagcctgtctcagaaaaacaaaaaacaaacacaaaaaagaacaagaagtcaagaagacgctgcagtgtttttaaataagtaaagccagatgtattgtcctaagcctayggtatgtttgtttatattctgggttgtttttttttaataacgattttttatttgtgcattaaatccccgaggatcttgcctgtcaacaacctccaggactacatcaaaggtataagtggctccataaacacttgttgtgcaacaaggttagaaaaatgagttttctagccagccatggtggctcatgccagcattttaggaggctgaggcgggaggatcgctcgagcccaggagctccgggctgcagtgggctatgatccatgccactgcactccagcctgagcgacagtgagactttgt

SEQ ID NO: 10559 - DNA, 601 bp, Human
gcattcactaaggagtaaatctaccagcatcctcctagaataaaccacagcattattcacaagagccaaaagttgaagacaacctaaatgttcactgacaaatgaataaacaaaatgtgatacacccatacaatgaaatattactcagccaaaaaaggaatgaagtgctgacacatgccaaaatatgtgtgaaacttgaaaacattacacttagtgaaacaagtcaaacttcaaaggacaaatattggatgattccacttatggtaggtatctggactagtcaagttcagagtcggaaagyagagtaggcagccactacaccctgaatgactgtaatttctgccatcagttgctccctgatttaaacaaaatttaaaaacaaaaataaatgaaaaataaaaaataaagtagaatgccggttaccaggaaccaagggaaagagagaatgaggagttaatgtttaatgggtatagattttctgtttaggacgacgaaaatgttccggaaatagatactgctgatgtttatacaatattgtgaatttaatgctgctgaactgtacacttgaaaacgcttaaatggtaaatgttatgtatatttc

SEQ ID NO: 10560 - DNA, 601 bp, Human
cctaaaagtggcgtgtttcctgagcaacttgcattcactaaggagtaaatctaccagcatcctcctagaataaaccacagcattattcacaagagccaaaagttgaagacaacctaaatgttcactgacaaatgaataaacaaaatgtgatacacccatacaatgaaatattactcagccaaaaaaggaatgaagtgctgacacatgccaaaatatgtgtgaaacttgaaaacattacacttagtgaaacaagtcaaacttcaaaggacaaatattggatgattccacttatggtaggtayctggactagtcaagttcagagtcggaaagtagagtaggcagccactacaccctgaatgactgtaatttctgccatcagttgctccctgatttaaacaaaatttaaaaacaaaaataaatgaaaaataaaaaataaagtagaatgccggttaccaggaaccaagggaaagagagaatgaggagttaatgtttaatgggtatagattttctgtttaggacgacgaaaatgttccggaaatagatactgctgatgtttatacaatattgtgaatttaatgctgctgaactgtacacttgaaaa

SEQ ID NO: 10561 - DNA, 601 bp, Human
tttgtccttgcagaatgctacagactcaaatggaatttgctgacaggaaaaaacactttttcctaaaagtggcgtgtttcctgagcaacttgcattcactaaggagtaaatctaccagcatcctcctagaataaaccacagcattattcacaagagccaaaagttgaagacaacctaaatgttcactgacaaatgaataaacaaaatgtgatacacccatacaatgaaatattactcagccaaaaaaggaatgaagtgctgacacatgccaaaatatgtgtgaaacttgaaaacattacayttagtgaaacaagtcaaacttcaaaggacaaatattggatgattccacttatggtaggtatctggactagtcaagttcagagtcggaaagtagagtaggcagccactacaccctgaatgactgtaatttctgccatcagttgctccctgatttaaacaaaatttaaaaacaaaaataaatgaaaaataaaaaataaagtagaatgccggttaccaggaaccaagggaaagagagaatgaggagttaatgtttaatgggtatagattttctgtttaggacgacgaaaatgttccggaaata

SEQ ID NO: 10562 - DNA, 601 bp, Human
aaaaaaaaagatagctaccttaaagttaggtcaagtgtttagcacatagtaggtgtgcaaaactgtttctttatattacattataagtaattatattaccgtttccttatattaagcaactctaaggcttgcagggccccatggtcacaaaacaaaatatctccactctaaaagtttgtccttgcagaatgctacagactcaaatggaatttgctgacaggaaaaaacactttttcctaaaagtggcgtgtttcctgagcaacttgcattcactaaggagtaaatctaccagcatcctccyagaataaaccacagcattattcacaagagccaaaagttgaagacaacctaaatgttcactgacaaatgaataaacaaaatgtgatacacccatacaatgaaatattactcagccaaaaaaggaatgaagtgctgacacatgccaaaatatgtgtgaaacttgaaaacattacacttagtgaaacaagtcaaacttcaaaggacaaatattggatgattccacttatggtaggtatctggactagtcaagttcagagtcggaaagtagagtaggcagccactacaccctgaatgactgtaa

SEQ ID NO: 10563 - DNA, 601 bp, Human
tcaaggccagcctggccaacatggtgaaaccccatctctactaaaaacacacacacaaaaaaattagctgggcgtggtggtacacatccagctattagggaggctgaggcaggagaatctcttgaacccgggaggtgaaggttgcaatgagccaagactgtgccattgcactccagcctgggtgacagagcgataccccatctcaaaaaaaaaaaaaaaaaagatagctaccttaaagttaggtcaagtgtttagcacatagtaggtgtgcaaaactgtttctttatattacattataagkaattatattaccgtttccttatattaagcaactctaaggcttgcagggccccatggtcacaaaacaaaatatctccactctaaaagtttgtccttgcagaatgctacagactcaaatggaatttgctgacaggaaaaaacactttttcctaaaagtggcgtgtttcctgagcaacttgcattcactaaggagtaaatctaccagcatcctcctagaataaaccacagcattattcacaagagccaaaagttgaagacaacctaaatgttcactgacaaatgaataaacaaaatgtgatac

SEQ ID NO: 10564 - DNA, 601 bp, Human
tgaatcgattcaccacttactgagagaccttgagcaggttgtttccttgtgtgtaaaatgagagctacctggccaggcatggtggttcacgcctgtaaccccagcactttgggaggccgaggaaggtagatcacctgaggtcaggagttcaaggccagcctggccaacatggtgaaaccccatctctactaaaaacacacacacaaaaaaattagctgggcgtggtggtacacatccagctattagggaggctgaggcaggagaatctcttgaacccgggaggtgaaggttgcaatgagcsaagactgtgccattgcactccagcctgggtgacagagcgataccccatctcaaaaaaaaaaaaaaaaaagatagctaccttaaagttaggtcaagtgtttagcacatagtaggtgtgcaaaactgtttctttatattacattataagtaattatattaccgtttccttatattaagcaactctaaggcttgcagggccccatggtcacaaaacaaaatatctccactctaaaagtttgtccttgcagaatgctacagactcaaatggaatttgctgacaggaaaaaacactttttcctaa

SEQ ID NO: 10565 - DNA, 601 bp, Human
gaaaacagcaaaaaatcagtaaaatgtgaaaaaatctgccccttcccaatagcgtaatactttccaatttagccacatgcacatctaaccctttgacattgcaaggcttctaatatgcagaatattcaatgataaaagtggtgaactagaaacagccatgggtttgtggttaccaagacctggggctgaatcgattcaccacttactgagagaccttgagcaggttgtttccttgtgtgtaaaatgagagctacctggccaggcatggtggttcacgcctgtaaccccagcactttgggargccgaggaaggtagatcacctgaggtcaggagttcaaggccagcctggccaacatggtgaaaccccatctctactaaaaacacacacacaaaaaaattagctgggcgtggtggtacacatccagctattagggaggctgaggcaggagaatctcttgaacccgggaggtgaaggttgcaatgagccaagactgtgccattgcactccagcctgggtgacagagcgataccccatctcaaaaaaaaaaaaaaaaaagatagctaccttaaagttaggtcaagtgtttagcacatagtaggt

SEQ ID NO: 10566 - DNA, 601 bp, Human
ctcttttggaggtgtgaatttttttcctaattttcaaagattattgaatgaaaatagcacgattatacatacattatgataagtatatgaaaaatacaaaaaggtgaataatacagaggacatagtaaaaatgaaaaataattttatgttaaagtggattatttttctagaatttcatgtgttattgctatactgttactatgataaaaaagaaaatacactattcttatacaacacgatgttccaacatattaagggtctataacaactcctatatccctttcggtccaaaccctggacsctgagtctgtcttcacataagagatttctctttccccagaggacattaccaaccatctgcccacataagtgctcagctgacttttttctacccactcacacagctctgtaagagttcccttccttttctctctcaattcagtatctcactaaacaaaaaggctgagtgttgcttacagtgagaaggtttgcaaaaatcctaacttcaattaatctcaacactgattcctgggcaggcaacccaatagtttaagcttctctatccagcagggccaacttacactcttcttttgtttcttat

SEQ ID NO: 10567 - DNA, 601 bp, Human
tgagacttaccttggaacaattactttgccttcatgaagtgtctttcatattatgctgaggcttgtccttgattagtctgcgataagtctggcaaagtcttatatttcactcaacgaataactattatgaggcatggcgggtagggcaaggaagaagacacaaaagcatttctaaaaatatacaatggaggcccagcgcagtggctcacacctgtaatcccagtactttgggaggccgaggtgggcagatgacttgagcccaggagttcgagaccagcttggccaacatggtgaaaccccrtctctactaaaaatacaaaaattagccaggtgtggtggtgtgtgcctgcagtcctagctactcagaaggctaaggcataagaatcgcttgaacctggaggctgcagttagctgaaatcacgtcactgcactccagcctgggcgacagagcgagactctgtctctctctacatatatatagatagatatatgaaaaaccaacccctatatacctgaaagccctccctagagtcaggggggagataccctgaggcaaatatgcattttgcatgactgaaaattttgctaactgccacatacc

SEQ ID NO: 10568 - DNA, 601 bp, Human
acagttgtcctccacagtgtctgcctccaagcccagggctcgatacttctggtttcctttaaaataaccccttatccagccatcatcaaaagactttcttcgtctatttaagctatgtacactgtcacccagggtggcaactttattgcagaagcaatacctaaaaactggttcttccaagtagaacctggaaggagaagggaggaaaaaaataggggctggcaggaaacccaaaagcaaccaattacctgtagtttagttaatagtattgtaaccatgttggtttcctggttttgagaaygtacttttgttatattaagatgctatcattgagggcagcggagaagggtacatagaacatctctgtgttacttttgcaacttcttgtgagtctaaaattatttcaaaatgtaagaaagctaccaatcaagggtcattttttaagaggttaaaggactgaggccaataatgactttaataaactattcttaattgctcagtgtttcaaaaccacctttagcttttgacggttctcaataagctttactttcaagtttatgtcctttcttaaggattttatgctctttgttaatgatttttt

SEQ ID NO: 10569 - DNA, 601 bp, Human
ctcagaattgtgactgttgacctatggaaccaaggaacaagtcacctgaagacacagttgtcctccacagtgtctgcctccaagcccagggctcgatacttctggtttcctttaaaataaccccttatccagccatcatcaaaagactttcttcgtctatttaagctatgtacactgtcacccagggtggcaactttattgcagaagcaatacctaaaaactggttcttccaagtagaacctggaaggagaagggaggaaaaaaataggggctggcaggaaacccaaaagcaaccaattamctgtagtttagttaatagtattgtaaccatgttggtttcctggttttgagaatgtacttttgttatattaagatgctatcattgagggcagcggagaagggtacatagaacatctctgtgttacttttgcaacttcttgtgagtctaaaattatttcaaaatgtaagaaagctaccaatcaagggtcattttttaagaggttaaaggactgaggccaataatgactttaataaactattcttaattgctcagtgtttcaaaaccacctttagcttttgacggttctcaataagctttact

SEQ ID NO: 10570 - DNA, 601 bp, Human
actgattttgttcaaagtgttaagacaaagtagtacctcagcaaataaagacctttgccatcccaaaataaatgcaaatggtttttgattccctagaagtactattctgtgctggaaactgaaagaaagaagggaaacataaaaatcaactctattataacaggactacaactgaacagaaaattaaggccctggtgcacacattataaatgagcagacagctcttccagtcactacagcagaaggcacttagtatcccaggattaaatccagatctagaaccaaattattgcctcactgrtttagaacaaggatgccaggctgtactgcaccccctctccacctcagaattgtgactgttgacctatggaaccaaggaacaagtcacctgaagacacagttgtcctccacagtgtctgcctccaagcccagggctcgatacttctggtttcctttaaaataaccccttatccagccatcatcaaaagactttcttcgtctatttaagctatgtacactgtcacccagggtggcaactttattgcagaagcaatacctaaaaactggttcttccaagtagaacctggaaggagaagggagg

SEQ ID NO: 10571 - DNA, 601 bp, Human
acgtaattcctgccagcctcaggaccaggggcaggaccagagaaatggcaaactcaaaacagaagctgatcacctggcacctgtgaaatgctaccccaggcagcccccctcatgtccttctgcttgttcctggttccagagtagccagctccaactgcattttgcacagaatttctgcactgctcagtttgtaagtacaggttcttccactgtaatcgggtatcaactagcattctatctgaaatgtatttttaaagctttcttctctttgccttccctttaataaaaagtgaaaagttgkcattttccttagggatatatatcaaatgacaaacacttctagagaatgagttgagaattccagcaaaaacttttttgttttttgagacacggtcttgttctgtcacccaggctagagtacagtggcacaaccacagctcactgcagcctcaacctcccaggctcaagcaatcctcccacctcagcctcccaagtagctgggactataagcatgtgccatcatgcctggctaattttaaaattattagtagagacaaagtcctgccatgttgcccaggctggcctcaaactcctgagctca

SEQ ID NO: 10572 - DNA, 601 bp, Human
acagaatgttctgtcagcagatcctggagggactgacattcctggtcagatccatggtgtgggcattaagcttccagtgtaccaacaactccccaaaaagggaggcctctaacgttaacagcctgaaggtgaagccattaatgcatgtgaagtgcactttctgctgagagaaggtcttgggtatgttttccaactttgggtacacttccagaaccatgcacgcttaagcactctcctcccttccaactccttcccggccacgctgctttcctttaaaaacacccgagactttaagccaatygccacctcccgctgcccggcagagtgggaagcgcttctcgcctttaatttgcctgtcttggtctgtgcccgtctctggtgacaccatcccggcccatgtgtcaggattcatccttctctgctccttccctctccacttagggtctctacaggctcatgtatccctgtagctatatcccttctctctggggctgttccacgtaattcctgccagcctcaggaccaggggcaggaccagagaaatggcaaactcaaaacagaagctgatcacctggcacctgtgaaatgctaccccaggcag

SEQ ID NO: 10573 - DNA, 601 bp, Human
gccgtggcaatgacagaatgttctgtcagcagatcctggagggactgacattcctggtcagatccatggtgtgggcattaagcttccagtgtaccaacaactccccaaaaagggaggcctctaacgttaacagcctgaaggtgaagccattaatgcatgtgaagtgcactttctgctgagagaaggtcttgggtatgttttccaactttgggtacacttccagaaccatgcacgcttaagcactctcctcccttccaactccttcccggccacgctgctttcctttaaaaacacccgagastttaagccaatcgccacctcccgctgcccggcagagtgggaagcgcttctcgcctttaatttgcctgtcttggtctgtgcccgtctctggtgacaccatcccggcccatgtgtcaggattcatccttctctgctccttccctctccacttagggtctctacaggctcatgtatccctgtagctatatcccttctctctggggctgttccacgtaattcctgccagcctcaggaccaggggcaggaccagagaaatggcaaactcaaaacagaagctgatcacctggcacctgtgaaatgc

SEQ ID NO: 10574 - DNA, 601 bp, Human
cagttgttaaaaagaaatagtgtgccatttttccagaaagagagggatgtaagaaagatggtaacaccactgatgttcagaatgagggtttattgctgcctctaatatacttgattttaaatgccacagactcctgaataggccgtggcaatgacagaatgttctgtcagcagatcctggagggactgacattcctggtcagatccatggtgtgggcattaagcttccagtgtaccaacaactccccaaaaagggaggcctctaacgttaacagcctgaaggtgaagccattaatgcatgkgaagtgcactttctgctgagagaaggtcttgggtatgttttccaactttgggtacacttccagaaccatgcacgcttaagcactctcctcccttccaactccttcccggccacgctgctttcctttaaaaacacccgagactttaagccaatcgccacctcccgctgcccggcagagtgggaagcgcttctcgcctttaatttgcctgtcttggtctgtgcccgtctctggtgacaccatcccggcccatgtgtcaggattcatccttctctgctccttccctctccacttagggtctct

SEQ ID NO: 10575 - DNA, 601 bp, Human
ttggtcagacagacacagcttgtcccgccagagggctccttgggtgccacatcacagtgagggaggggcagggaagaggggggagttgggggaagggagctccctccttggcccttgcatgggcagacaacagaccccaaatggacagagcctgcaatcctatttcctctgcctgatgccatgatcttttcacaggtcttctgcattttctgccacctgtccccccaagttcccacctacaacttattttatccaaaatctacttctacttttttacgaattataagaaattaacagatgrgcactttaaaaccaggaaacaaataattggcttggattccgggaggctgagaggcatctatgggatagaggcttggaagcaggaaagctgggtttgaatccagaccctgtcaccaaggactagggagaactcaggctctcttcaactcactgctcggtttctgcatcagtcaagtggggaggatattaactattatagggattaaaagagataaacaccacacaaatgttcctacacaaagaaaactttggcctcggttttcccaaaagtcaattactgaagcaatttcctgtgaggata

SEQ ID NO: 10576 - DNA, 601 bp, Human
cccggcttcataatttctaaaaacaaatcacttagaaccaactttaaggctcaactcataccagatcattctatctgccttgggcttattaacctttcaggagtgccaagagatgccctatttatcctgcagtagaactgtctatacatacttgaaatttggatagattctttgtgtgtgtagaggcacaacagcaaaggtggcctcactcctgcccagcgggtctacacctgacttgccggcagccacatctcagagcaaccagtctttcatctcaagctgacaactagcaagctgaagscttctttaacttgcagggaactcaatcctctatgcttcctctcctcctcccaccgtgacaacaaggcatatttcactaactagatcacgaagaatccaatgatcaaaagattttagttcaagttccagctctgtcccttgaataggagtgcaacctgggccacggtttcttgaaatataaaatggaagtaacaatgctcacagcatcaattaagcctatgatgcgctcatgagggagagcagtgttttatgagcagtacaggcttgcacggatgaagtatgattatgatcattactgctt

SEQ ID NO: 10577 - DNA, 601 bp, Human
ctgggcttagcatttctaaggaaactccttaacaaccaggctccttggtagtgttctgtcttctcagcaacaaagacccttgagtaatcagtggacagtgaaccagacaatttcatgaacacaaactgggtggagagtagcccaccaaccacataccaactccagagaaagacccagtcacgatgggaatgtgcgtttgaaacaaaaagcagggaagaaatgaacaaaagaggggtgtgggcctgagtggggaagaaccaagttggggagagagatgtgcaaggcaagggagggcagagaracaaagatcgttgtttaaaataccccaatgggcaaaaatatgcatgcttatgccacatcacctgtgtttgtttctatttctctcgccatttaccagactagtatttatttggggggcatatttgatgttttgggacatcacaggcacaactcattatcattggaaactacatatataaatacaggaagacagattccaaattttagctctatcgaaaaaagaaaacaagaagaaagagaaaagacagcactagatttgtctaccagctacaataagatagccaacaggcagagaaaaggg

SEQ ID NO: 10578 - DNA, 601 bp, Human; identical to SEQ ID NO: 2158

SEQ ID NO: 10579 - DNA, 601 bp, Human; identical to SEQ ID NO: 2159

SEQ ID NO: 10580 - DNA, 601 bp, Human; identical to SEQ ID NO: 2160

SEQ ID NO: 10581 - DNA, 601 bp, Human; identical to SEQ ID NO: 2161

SEQ ID NO: 10582 - DNA, 601 bp, Human; identical to SEQ ID NO: 2162

SEQ ID NO: 10583 - DNA, 601 bp, Human; identical to SEQ ID NO: 2163

SEQ ID NO: 10584 - DNA, 601 bp, Human
atatattttgctaagattggaacctctcgaagcatgagttcatttctgatctaagtctaggccctccctctggattcatatatcacagagaagcaggaggaaaacaactagaattgcaaccaaagatgccacacaattctttttctttctttttttttttttttaaatttgagacagagtctcacactgtcgcccaggctggagtgcagtggcacaatctccactcactgcaacctccgcctcctggttcaagcgattctcctgcctcagcctcccgagtagctgggattacaggcacccrtcaccatgcccggctaatttttttgtattttcagtagagacagggtttcactatgttggccaggctggccttgaactcctgacctcgtgatccacctgcctcggcctcccaaagtgctgggattacaggcgtgagccaccacgcccggcctcacacaattctttttcaactgggtttcccaagagagcaatctctaaggtttgccaaaattggtccagaaagctctacaagcttctatgcctatgacttgacctttacttttttcccctgaaaataaaccaaaaagccaatgtataaatg

SEQ ID NO: 10585 - DNA, 601 bp, Human
ctctgaggtcagaaactgtgtaagtgagcaattaagtgcttatcacttaataagtgaatagcagctgccatatgcaggctctctagactgagttctagcctctgaccctgccctcaccaaatggaagagtccccacctattgaggaatctgcctgaattttcaagaaagtattaccaattattcacactctattgatgaccactttgaaaaaatatgaaatgtatgcacaaagactaagaagagactcacagatttttaaagtatgtgttatgatagtgaatttaagagtgttttttttttgttattgttattgggttgtttcaacagtagaaaattattttaagactatgttatcaccaacattccatttatatattttgctaagattggaacctctcgaagcatgagttcatttctgatctaagtctaggccctccctctggattcatatatcacagagaagcaggaggaaaacaactagaattgcaaccaaagatgccacacaattctttttctttctttttttttttttttaaatttgagacagagtctcacactgtcgcccaggctggagtgcagtggcacaatctccactcactg

SEQ ID NO: 10586 - DNA, 601 bp, Human
acaggagtctgtgtgacacaccagattcaggctctgaggtcagaaactgtgtaagtgagcaattaagtgcttatcacttaataagtgaatagcagctgccatatgcaggctctctagactgagttctagcctctgaccctgccctcaccaaatggaagagtccccacctattgaggaatctgcctgaattttcaagaaagtattaccaattattcacactctattgatgaccactttgaaaaaatatgaaatgtatgcacaaagactaagaagagactcacagatttttaaagtatgtgttatgatagtgaatttaagagtgttttttttttgttattgttattgggttgtttcaacagtagaaaattattttaagactatgttatcaccaacattccatttatatattttgctaagattggaacctctcgaagcatgagttcatttctgatctaagtctaggccctccctctggattcatatatcacagagaagcaggaggaaaacaactagaattgcaaccaaagatgccacacaattctttttctttctttttttttttttttaaatttgagacagagtctcacactgtcgcccaggc

SEQ ID NO: 10587 - DNA, 601 bp, Human
ggggatcctatgtcttctctgcactatttttttccctaccaagaagcagaatttggctgaatgtctgtggagaaaacgcctcctatagtcaatatctgaaagtcagtcaaaaatataatttttctttctgaatcaaattcataaactattttgtgaaacatttgaaaggttcaggactgaatacattctaaccatgtttccatgtgtctctctcagactgctaagagacaccagggacttctgaatcaaacaatttggctctggccagtagctgggaagaggccacactgcagccttcctrgataggaagccactgctaccttcttctccaggaggggcccacagactctgtgatgggcagaaccacagtgggatcaagagaatggcagatggctgttgctgctttctttacattttaccttctccttatccatttccttctgccattttggttttttatttcagaaaggacaactggggttttcttcccatcttgtcaaggattgagtggagaggaaacaggagtctgtgtgacacaccagattcaggctctgaggtcagaaactgtgtaagtgagcaattaagtgcttatcacttaata

SEQ ID NO: 10588 - DNA, 601 bp, Human
ttgtatcttccctaaggacaatttttcctagaagagggagccaagagagagcaaagttactattaaagccatctgatactaataccttacatattattcaagtcattaaaatttttttttttttgagacagagtcttgctctgttgcccaggctggagtgcagtggcatgatctcggttcactgaaagctccgcctccggggttcacaccattctcctgcctcagcctcccgagtagctgggactacaggcgcctgccaccacgcccggctaattttttgtatttttagtagagacggggyttcaccgcgttagccaggatggtctcgatctcctgacctcatgatctgcccgcctcagcctctcaaagtgctaggattacaggcgtgagccaccgcgcccagcctcaagtcattaaatattttaagtagtatgactgttgcgtagtctttcatccaaaagtagtccataaactacttccaattttttgtcaccataaggctgtggtgagccaggaaggatgacatgttttataagtaggtgatgtcaagtgagaaataaattgcttagtatgcacctgaacataaactgacagcacaatg

SEQ ID NO: 10589 - DNA, 601 bp, Human
cacttccgcctgcacaatttcagaacaaacaacttagagtcaacttctagaaggtcctggcagagaaaccattattctgaccataaaaaagtataaacaggttcaatcataggctctgggtaaagataagaaattacaggcagtggcattctccaactccaacccagccaggaacagtgcattagaaaaaatgcccgccttgacgacagaagcatcccttagctgtggatgctgttagatggcctctcacagcaatgtgacctgcaggggataaataaagcaactcaaaacctccattcayagaaacagggtccttatcataaatggaatgaatcctaaatagaaacaggtagtttccttctttttgcaaagaacatctttcaagagcaggccacagaggtggatttaaagtcagacatgtgaatattccatacccctaaatcccacaagttgataactaacagtccattcagggaaacaagaatgagaataaaaccagagtgagaataaaaccaggacaaagagctccctgtggcgctgggagataggcctgttatcagctccatctccagggcacagggtcaggggaagtagagcgtgc

SEQ ID NO: 10590 - DNA, 601 bp, Human
cctggtatgaaaacagagccccagccatcaaaggggcctcctaccctttccccaggatgattattccctgccttggtcagtgaagggagccaccagcacgtgtagacacctcctaagcacaggtgcaaggcaggcacgtgacttgtttacactagagggcaaaaagaaacgcaaactctcccacgtgccctgttcacgatactgagttatgactcagccagttcccaccgctcaacccagaacagcagctgtcggtggggctgcggagcccacaacacagctcacagcagaaggcagagcmaggaaaccacggagtcctgcacttgggatgtcgcctcagagaccaaaacagtagaaggattcagaagtgcacatgaaaccactgccgtctgccacatagaaagccaaggggaagctgcgccacacctgtctgacaacaaccctacagggcagagggtctgcacacctgcatgcgcaatgcccagagaaatccaatactttaatggtgcttccccaaagacacggcagcacaggaagagcaggcagcctggcgctggatcaagccccggaaacctgtggtgcgatctgctagcagaagcag

SEQ ID NO: 10591 - DNA, 601 bp, Human
aaattcctgtctcctttcatctttgctcagtggacattccaagcaagaaggagcctctgacttaaaataaaaaattgacattctcacctggtatgaaaacagagccccagccatcaaaggggcctcctaccctttccccaggatgattattccctgccttggtcagtgaagggagccaccagcacgtgtagacacctcctaagcacaggtgcaaggcaggcacgtgacttgtttacactagagggcaaaaagaaacgcaaactctcccacgtgccctgttcacgatactgagttatgactcagccagttcccaccgctcaacccagaacagcagctgtcggtggggctgcggagcccacaacacagctcacagcagaaggcagagcaaggaaaccacggagtcctgcacttgggatgtcgcctcagagaccaaaacagtagaaggattcagaagtgcacatgaaaccactgccgtctgccacatagaaagccaaggggaagctgcgccacacctgtctgacaacaaccctacagggcagagggtctgcacacctgcatgcgcaatgcccagagaaatccaatactttaatggtgcttcccc

SEQ ID NO: 10592 - DNA, 601 bp, Human
acctactcagggaagtccaccagggagggcttctctgacaaacagacagtgaagctgaaatctgaaacacaaacaggcacaggttagacattaaaaggaaaacagattccgggggaggaagcaggaatggacaagtggagcacagggacttccggggcagggaagctactctgtgtgatatttaatggtggctacctgttgtcgtacatttgttaaaacccacagaactgtacaaaccaagagtgaaccctaatgtgaactatggactctggttgataatgatgtgtcaacactgactggktcactgattgtaacaaatataccacactgatgtggaatgctgatggtgggggaggttgtgtgcgcagtggtcagagggaagttgtgggaattctttattttctattcatttttgctatgaacctaaaactgctataaaaaataaaatctactgaaagaaagaaagaaagaaggaaacaaagaaagaaagaaggaaggaaggaaggaaagagagagagaaagaagggaaggatgggaagggagggagggagaggagggaaggaaggagggaggcgaggaaggggagggaggggagggagcg

SEQ ID NO: 10593 - DNA, 601 bp, Human
cactgaggaagaggggacaggtttcaaggcaggaatgaggaaggaaaggggactgacctgggcagccagtgggcagctcccacagtagatctgagcttggggacagaggagtctccacagcacataagggaaaacaaggttagagggtctctgtgattggtttcccgaatcatgttgacattcaggcatatttccatccctttaaaacaatatacacattctttttagtttgtttttcctacttccatccactgtttgcaatgaaatatcttttttaaaaaaatctgttctgtggctaaayttaatgaggccaaaagtgtagcatttctttccttgggaaaaagaaatcttggcctatgactcaggatacagacattcctcttgagctcaaatcccagcaatgtgcaggatgacatttctaatctgtactctgtgacacagtccaatctgaattatagaacattttggaatgaagaaggttgaaccatatgaattttccatttttgcaggaaaaacatcaataggcaaataacaaatatcatcaataaatatcaataattttatatggttcaatctaatgtttccaaacaggttgttttat

SEQ ID NO: 10594 - DNA, 601 bp, Human
agccgatgggtctgagacaccctccaaattaggaatgagaaggcagatatcagagtttccattttacagacagggaagccagaggcaaagataagcatttcacatatccatcagcatgctaaccttgggacagtaccagtggcctccctggaaaatcctgagggctgatagagtcacatgataactgtttctgatagagaggaaactcttagctccagaaaagagtggcacatgcaactttcttcccctgggactgtttcagtaccattctacagttggcaaactgggtcatgtgggtaaattgtgatggttccatagactgggactgtgctctctttggaagcacactcttcccacttctgtgttcctgtgtgacttcaaaagatggcagatactctaatgtcaaggttaagccataccagcaggtagataaggtttccaattctggtgctgccttttgtggctgtaaaactttggggaagttacttcacctttctaggcttgtttcctcatcaaaggagatagtaaagccaccttcaaaggagtatgtgaaagaaaccctgttaaatgcctggtacagagcctggctctcaaaagcact

SEQ ID NO: 10595 - DNA, 601 bp, Human
ttaacaattgtccaaatgaagaggccctcaagactgttatcaacgcagcccaggggccccagttatcacagaagagtcaccaggcacatgtactctctctgctggaaaagatccaccacgtgaaaagcagcattgtgcctcagtgctatctgagcaagcccaagggagaagagccgatgggtctgagacaccctccaaattaggaatgagaaggcagatatcagagtttccattttacagacagggaagccagaggcaaagataagcatttcacatatccatcagcatgctaaccttgggwcagtaccagtggcctccctggaaaatcctgagggctgatagagtcacatgataactgtttctgatagagaggaaactcttagctccagaaaagagtggcacatgcaactttcttcccctgggactgtttcagtaccattctacagttggcaaactgggtcatgtgggtaaattgtgatggttccatagactgggactgtgctctctttggaagcacactcttcccacttctgtgttcctgtgtgacttcaaaagatggcagatactctaatgtcaaggttaagccataccagcaggtaga

SEQ ID NO: 10596 - DNA, 601 bp, Human
attaacaattgtccaaatgaagaggccctcaagactgttatcaacgcagcccaggggccccagttatcacagaagagtcaccaggcacatgtactctctctgctggaaaagatccaccacgtgaaaagcagcattgtgcctcagtgctatctgagcaagcccaagggagaagagccgatgggtctgagacaccctccaaattaggaatgagaaggcagatatcagagtttccattttacagacagggaagccagaggcaaagataagcatttcacatatccatcagcatgctaaccttggsacagtaccagtggcctccctggaaaatcctgagggctgatagagtcacatgataactgtttctgatagagaggaaactcttagctccagaaaagagtggcacatgcaactttcttcccctgggactgtttcagtaccattctacagttggcaaactgggtcatgtgggtaaattgtgatggttccatagactgggactgtgctctctttggaagcacactcttcccacttctgtgttcctgtgtgacttcaaaagatggcagatactctaatgtcaaggttaagccataccagcaggtag

SEQ ID NO: 10597 - DNA, 601 bp, Human
tgtcaatgtctgtcttaaacacagctcccagaggcaggccaggcatggttccctggatgtggtctgacctgcacagaggaactaggctggaaaagtggcctgtgggctctgaattggacctggagcatgaggcctgtgtttggcagctgaatcttcctactggctcatgttaagcctggggatccccaggtccatttcatagtaacttatttacgcaaatggacaatggcagagcatgacaagtgagacaggcagattcaaggacgccccgtgggaaggtgcaggggaaggcccagaccaycaattcttgggaatctgaggaaagccaacgtcccactcagctgtcggaaaacacaagtggggcctgcctgaacatgggctggctcactgagcttggcttgctagttcaaacacaagggagttctggaataaagatgccatcccagagactgtagctttaaatttctaggttctctgatcccgaggtcaatctgcctaattaaaattaacaattgtccaaatgaagaggccctcaagactgttatcaacgcagcccaggggccccagttatcacagaagagtcaccaggcacatgtactct

SEQ ID NO: 10598 - DNA, 601 bp, Human
caccacgaggtctatttccaactcctgcttccacactcatgcgagggaacgacctcacttgtttcgtcacccacagagataggtaaaaggacttctcccttcacctattcccaggatctcacagttctggtcctaggccctaggatgcctttcagccagtgctctcctctccgtctgaaacaaactggcatgtcctcccagcctcgctctgatctcaccatcccaagggaagaagtgctcctccctccttgaggaaacacagccctgcaaaccccaccctctttggagaatttattccatygtcactgtctcctctggtcccttccatgtgcctacaaatatgttcatggcccactaataacaagccttctcttcaccctgcgacgccaccaaactctcatcactcgcctctctcttttaagaccagcagacctatttcctcctctcagttccttaaaatctgacctcactctcagtcatccatgaaaaggggaagcaggaatgagatggaagaccagcccttcccagtcactgagaaaattaacaaaaatggactcctcccaggagtgaagacagactcgctggcttgttcacttccaac

SEQ ID NO: 10599 - DNA, 601 bp, Human
caagggccagagaagccagattcagatgaccaaactcttgcccacattcgtatacagagaagaactgtgcatgtaataaatgggataattcataaacgtgcctggttcatgatgggctctcaacttgtggctgctggatccaaaataaatgtttgttgaatggaaggttgcatctaaaatggaaatagctccacaagtgaaggatggctcagcataagaataataattctgttttctgtgaagtgggctcttgttatgtaaatggtgttaacaaacttggcccagaggttgggctgctgcraatgagtcaggacatgctcgttcatcacccaggctttcaggcttggaggctttacaagtggtgactccacagagtatttacattaaaaataatttcccttattgttgggttggctggcagagctagctgttttgaaggcttgagttctgtattccacgtttggggaaggaagcaaaagtgggaaagtggattgaaacacaaaacaacaaaacaaaacaaaaaaaaacaatgaactacaaatggaatatagcatgagggccagagtacatcagctttggaacagattctgaggtcaaatct

SEQ ID NO: 10600 - DNA, 601 bp, Human
acagagatatcatttcaggattggaagagccgatggtgttgagacgccatctctctgcaaattggtttatagatttgacacaatcacaatcaaaagcctagaaggcctttttgagaaaatgacaagctgattataatatttatatgaaattgtaagcaatggaaactagcaaaacaattttgaaaaagaacaaagttggaggacttcgtatcttaggtcaagacttattacaaagctacagtaatcaaggctatggtcatgacaaaatatatgcaatgacagaatgcatagatcagtggamtgggatagatagagcaaaaatagatccacacatatctagtcaattcagcagcaaatactggaactggatattcatatgcaaaaaaaatgaagttcaacccatatgtctcatcacacacaaaaattaactcaaagtggatcattgacctaaacgtagacctaaagctataaaacttctgaaggaaacctaggagaaaatctttgtgactgtgacataggcaaagatttcttagataagatgattcataggataaaaagttgatgaactgggcttcatcaaaacaaaaacttatttgttcaa

SEQ ID NO: 10601 - DNA, 601 bp, Human
aggaagcagaaaaccaacttttaatttgacaaattgtattaagaaccttaaggaaaatcagaaacctaaataaatggacagagatatcatttcaggattggaagagccgatggtgttgagacgccatctctctgcaaattggtttatagatttgacacaatcacaatcaaaagcctagaaggcctttttgagaaaatgacaagctgattataatatttatatgaaattgtaagcaatggaaactagcaaaacaattttgaaaaagaacaaagttggaggacttcgtatcttaggtcaagasttattacaaagctacagtaatcaaggctatggtcatgacaaaatatatgcaatgacagaatgcatagatcagtggactgggatagatagagcaaaaatagatccacacatatctagtcaattcagcagcaaatactggaactggatattcatatgcaaaaaaaatgaagttcaacccatatgtctcatcacacacaaaaattaactcaaagtggatcattgacctaaacgtagacctaaagctataaaacttctgaaggaaacctaggagaaaatctttgtgactgtgacataggcaaag

SEQ ID NO: 10602 - DNA, 601 bp, Human
aaaacctattaaataaataaggcaatgcattataagccatggattgtggaaaagagggagccagatgcttgggaaataaaatacaatagagagaaagtataaactagtagagttttttgcaggaaacatgtgaatctgttatccaaaagggcacagccatgtgctcaacaccctagcaaggaagcagaaaaccaacttttaatttgacaaattgtattaagaaccttaaggaaaatcagaaacctaaataaatggacagagatatcatttcaggattggaagagccgatggtgttgagacrccatctctctgcaaattggtttatagatttgacacaatcacaatcaaaagcctagaaggcctttttgagaaaatgacaagctgattataatatttatatgaaattgtaagcaatggaaactagcaaaacaattttgaaaaagaacaaagttggaggacttcgtatcttaggtcaagacttattacaaagctacagtaatcaaggctatggtcatgacaaaatatatgcaatgacagaatgcatagatcagtggactgggatagatagagcaaaaatagatccacacatatctagtcaatt

SEQ ID NO: 10603 - DNA, 601 bp, Human
ggaacctggagtgagaagcctagaaggtcccttactgcaatgaaatgctaagccataacaaaactacttatgggtaggagttggaatagtggttctccttgctgtcaggattggaaggggtcacaaagaggctttcaaggtgctggtgatgttctgtttcttgaccttatgagcatttatcgagatgtatagtatatatataaactatatataaatatatataaactatatatataactatagtttttgatgtgtacattttgataaagagttaaaacctattaaataaataaggcaatgyattataagccatggattgtggaaaagagggagccagatgcttgggaaataaaatacaatagagagaaagtataaactagtagagttttttgcaggaaacatgtgaatctgttatccaaaagggcacagccatgtgctcaacaccctagcaaggaagcagaaaaccaacttttaatttgacaaattgtattaagaaccttaaggaaaatcagaaacctaaataaatggacagagatatcatttcaggattggaagagccgatggtgttgagacgccatctctctgcaaattggtttataga

SEQ ID NO: 10604 - DNA, 601 bp, Human
ctcagaggggaaaggagcacagtgaagaggccagacacattttaggaacctggagtgagaagcctagaaggtcccttactgcaatgaaatgctaagccataacaaaactacttatgggtaggagttggaatagtggttctccttgctgtcaggattggaaggggtcacaaagaggctttcaaggtgctggtgatgttctgtttcttgaccttatgagcatttatcgagatgtatagtatatatataaactatatataaatatatataaactatatatataactatagtttttgatgtgtayattttgataaagagttaaaacctattaaataaataaggcaatgcattataagccatggattgtggaaaagagggagccagatgcttgggaaataaaatacaatagagagaaagtataaactagtagagttttttgcaggaaacatgtgaatctgttatccaaaagggcacagccatgtgctcaacaccctagcaaggaagcagaaaaccaacttttaatttgacaaattgtattaagaaccttaaggaaaatcagaaacctaaataaatggacagagatatcatttcaggattggaagag

SEQ ID NO: 10605 - DNA, 601 bp, Human
ctcaatattcatccagcattcaatcactgatctcttactgcatgccaggccccacagaaggcactgggtccacagaaaagctagttccagacctcaaagagcttatagtcaaatggaaacagcaacttcaatacaccatgacaggagtgttaatgaaggaaagtccaatgctaatggaagccagggagaggaggaggagggagaggcttcccagcgcagacgaaacttaaactgagctggaaaaaatgaggaggacacttcaaggaagctgaaagagggtgggatggctcacacctagaakcccaacactttgggaggctgaggtgagaggacggcatgaggccaggagttcaagaccagcctaggcaacatagggagaccccatctctacaaaaaatattaaaaaattagccagccatggagatgtgcacctgtcatcccaactattcaggtggccaaggcaggaggatcacttgagcccaggagtttgagactgcagtgagctatgatcatgccactgtgctccagcctgggcaacagagcaagatcctgtctgtaaaaaaataaataaataaaaataaaaacaaataattttaaaaaa

SEQ ID NO: 10606 - DNA, 601 bp, Human; identical to SEQ ID NO: 2164

SEQ ID NO: 10607 - DNA, 601 bp, Human; identical to SEQ ID NO: 2165

SEQ ID NO: 10608 - DNA, 601 bp, Human; identical to SEQ ID NO: 2166

SEQ ID NO: 10609 - DNA, 601 bp, Human; identical to SEQ ID NO: 2167

SEQ ID NO: 10610 - DNA, 601 bp, Human; identical to SEQ ID NO: 2168

SEQ ID NO: 10611 - DNA, 601 bp, Human; identical to SEQ ID NO: 2169

SEQ ID NO: 10612 - DNA, 601 bp, Human; identical to SEQ ID NO: 2170

SEQ ID NO: 10613 - DNA, 601 bp, Human; identical to SEQ ID NO: 2171

SEQ ID NO: 10614 - DNA, 601 bp, Human
cacggtggctcatgcctgtaatcccagcactttcggaggccgaggcgggtggatcatgaggtcaggagatcgagaccatcctggctaccatggtgaaaccccgtctctactaaaaatacaaaaaaattagccgggctggcgggcgcctgtagtcccagctactcaggaggctgaggcaggagaatggcgtgaacccgggaggcagagcttgcagtgagccgagatcgtgccactgcactccagcctgggcgacagagcgagacttcatctccaaaaaaaaaaaaaaaaaaaaaaaaaaaawaaagaggtatgtctgtgtgttgtgaagtgggtgagggacaagtgtgaaggcagggatgggagaggatctacagtggaatatggagaaacccgaggagaccactgctaccagccacgagactgtccctgtctccgcaagctctttccctgaagccagggggatgagtcagcttatatccgccttggccgtcatgagtgctatgaatgccaagaggatatagccacctatttgtaaggtctctataatttttttgtttctaactagattcttttaagtgtagaagagaattatccctcactg

SEQ ID NO: 10615 - DNA, 601 bp, Human
tttttaaatcttggctttcctgctttataacataagctgttttctccagctctgcagccttcccacatttgataaggtctcctatgagttcaacccaagccaatgataaacacaacagacaagagacattggaacctcagtcaagtcctccctctggctgcattatcaacactctcagaaaacatgttcacccagctacaaatccgcatgactgtgctgttgtcaacccatattattaaatatttgccttatttataaggatgtcattagaaattgtcaagagccttcctgaaacctggcrtatgctagattagacagtccatccctctcccatctcttttccatcatacctatttctccaagtaaagggttccttgtttgggtatatttcccacattatccttcagctttcctgacatgctacaccaaacattccacccacagatctatagaattcacttacatgttgttggggttttttggtatttctgcctcattccatttttttttttttttttttttttttttgagactgagtctcactctgtcgcccaggctggagtgcagtggcgcgatctcggctcactgcaagctccgcctc

SEQ ID NO: 10616 - DNA, 601 bp, Human
ctgctttccactggccaaaggatgatgctcttcacaccctagcagacacatcttgccaatatgcacatgggaggcccactgatgggaccagcccaccccggctttctctgtctgggaaactcctactggtgctctgagcctcagctccaacagctccctctgcagtgctgggcccttcttccttgggctcctgcagtgccacacctggctttcccacagcactcatcaccctctacggggctgactcctctgcatgttatttcctccaccagactctgagcccctgatctgtggcctcatytgtccatcttgagtgagcacgggatttggtacataaacacttactgagtacgagtggatgtcagcacagtcactggcaagttctgaaatgtatggcttggggacacacgtccagagggaaatactcacacactcagtagcacccctgcttgccaaagcccaactgtcaatgctttggagacagttcagcctgagagaagggatggaaagtttgccttcttgggccagggttaagaaaaccagactggtcccagctgtaagtgcaccccttctgtcttggggatcagaggaactgacagac

SEQ ID NO: 10617 - DNA, 601 bp, Human
tccctactggatttggaaagaatccagaaaggctggaaggcagctggaatgaggcctcttcgagtccctcccctgattcctgagaacttcaactgatactgaaggctccccagttcctggacactttccattcattcgctctgagattccagaggaaggtcacagacacagcagccctcccactcggtcttgttattagaacttcattgggattctcctggttcccctgtggagctgactggcctgatgcaccctttcaaaagggctgcccagcccccaccctgaacccaccaaatccagsgctatcctatgcagatgccaagtctgctcagatctcaacaaaaaaggagctgggatgggcacaggctacagagtcccgaggagtggacgggagcggggagggggtgctgtgggaagcccatgacggggttcactggctgctttgtgctgggcgtctgtgctagcctcacagccagccacttgcatactgatttgttgaagccagttcctgagtaaactgactcccgatggttggtgtaggataaagggaggaaaattagggaaacaattgaaatcactgggaaagagaatctcactggat

SEQ ID NO: 10618 - DNA, 601 bp, Human
gtgagatcttgtctcaaaaagaaaaaaaaagcaaaacaaaacactaataattattagttgccaagtgcctactatgtaccaggcactgtgctggacttttccacaagcatctcttttaaatgccctagaaggaagtgtcctcattttaccagagagaaaacagggttggcggggttggtggatttagtcatgctcacacagctgatgagtggggccaggcctagagcagggcccgcgctctccttagcatatccacctcctagacgggggaatgaggtctacctcatcggggtgcgcagggagagccagcctggcttactaaagggaccccttgatggtgatccccaaagtggtggccagaggcatctccacatctttctgccgtgggctgggaacgatttgagcctgcagataggataagagtggggactatgcctgcccgaagccacccgtggggccatcaagaatgcagaggtgaatggagctttgaggggcagatgccatccctcccttctgaggcccagagagaaacttgcttgcatctcctattactatttgcttgaagctcccacaacagtgacatgcttgaagctacctgtag

SEQ ID NO: 10619 - DNA, 601 bp, Human
ggagagccatgtggggtctgaatcacccatcagggccctgagagcaagtcactgtggattctatgaaaacgcacagacaggtggccagtgtgccctgatgaaatgccgttgtaaagttttactcaggggtgggttctcccttactccctgaacagacagaggcccggcccaccccacaaacagactcactggatctgggtccaaatgtctttatttttcaaaaggctcctcagatcattctgaagctcagaatgggttaaaaaccactttcagctattactattcttaattctattctttyggctagaataaagcttttttttttttttttgaggtggagtctcgctctgttgccaggctggagtgcggtggcatgcactcagctcactgcaatctccacctcccgggttcaagccattctcctgcctcagcctccagagtagctgggattacaggtgcgcgccaccacacgcagctaatttttgtatttttagtagagatggggtttcaccatgttggccaggatggtctccatctcctgacctcgtgatctgcccacttcggcctcccaaagtgctgggattacaggtgtgagctactg

SEQ ID NO: 10620 - DNA, 601 bp, Human
cacagggctgggatggaaggaaagcaagaatgaggcttggtctgattcaggaactagagcctgactcccccaccctctcctcctcacccccctgaggagagccatgtggggtctgaatcacccatcagggccctgagagcaagtcactgtggattctatgaaaacgcacagacaggtggccagtgtgccctgatgaaatgccgttgtaaagttttactcaggggtgggttctcccttactccctgaacagacagaggcccggcccaccccacaaacagactcactggatctgggtccaaaygtctttatttttcaaaaggctcctcagatcattctgaagctcagaatgggttaaaaaccactttcagctattactattcttaattctattctttcggctagaataaagcttttttttttttttttgaggtggagtctcgctctgttgccaggctggagtgcggtggcatgcactcagctcactgcaatctccacctcccgggttcaagccattctcctgcctcagcctccagagtagctgggattacaggtgcgcgccaccacacgcagctaatttttgtatttttagtagagatggggt

SEQ ID NO: 10621 - DNA, 601 bp, Human
ttctcactcaggagcttctcacagattgccttgaaaacaggctcaaggtgggcctggatgggtggcagatggtgcgggagggatgcctgtcagctgcccacagggctgggatggaaggaaagcaagaatgaggcttggtctgattcaggaactagagcctgactcccccaccctctcctcctcacccccctgaggagagccatgtggggtctgaatcacccatcagggccctgagagcaagtcactgtggattctatgaaaacgcacagacaggtggccagtgtgccctgatgaaatgccrttgtaaagttttactcaggggtgggttctcccttactccctgaacagacagaggcccggcccaccccacaaacagactcactggatctgggtccaaatgtctttatttttcaaaaggctcctcagatcattctgaagctcagaatgggttaaaaaccactttcagctattactattcttaattctattctttcggctagaataaagcttttttttttttttttgaggtggagtctcgctctgttgccaggctggagtgcggtggcatgcactcagctcactgcaatctccacctcccggg

SEQ ID NO: 10622 - DNA, 601 bp, Human
tcccggaatcccaccggccgcagggcaaacacatgctccgtgtgtctgctgggacagcttcgggcctccaatgatacttcaaaagatgcctgggcagaaggaagagaagggatatcatggctgcggcaagccagggtctcccattcacccaggggcagggcccttgatgaagagcagctgcgaactccagccctctccacgcactcaggtagaaccaccaagatggccggagtaggaagagacctcagaaccagcaagctcccatgcttcatggagaagagaatgcacaggtgagctcacrtttgacaggtgaattctttaacattcattatctctttgcatccccatgaccctgaggaaatgggcccctgcggaaagctatagggcttccttgagttcacacagttcttattctccctttcttttctcttctgtcctatcctcttcccagccccgctgcagatgcctcttctctgctcacttaaaaagtcatttggtggaaaaacatttcctgggcgctgcctctgtgccaggcacaatggcactctcacagggtgccgggtgaagggcacccacctggcccgccatagagagggctctg

SEQ ID NO: 10623 - DNA, 601 bp, Human; identical to SEQ ID NO: 2172

SEQ ID NO: 10624 - DNA, 601 bp, Human; identical to SEQ ID NO: 2173

SEQ ID NO: 10625 - DNA, 601 bp, Human; identical to SEQ ID NO: 2174

SEQ ID NO: 10626 - DNA, 601 bp, Human
tggccaacatggtgaaaccccgtctctactaaaaatacaaaaattagccgagtgtggtggcgggcgcctataatcccagctactcgggagtctgaggcaggagaattgcttgaacctgggaggcagaggttgcagtgagtcgagatcctgccattgcactccagcctgggcaacagagtgagactccatctcagaaaaaaaaaaaagaggaattctggcaggaaaaataagagcccccagagatgtccacatcctaatccctggaacctgtgactgtgtggccttacgtggtgaaagggaytgtgcagatgtgagtaagctgaggacctggggatggggagactttccagggttcgactgagggtcccttgtaaccacaagggtctgtaggagagggagaaggatttgacaacagaagcagaggtcagagtcagagagatctgaggatgttactctgctggttttgaaaatggaagaaggagctgcaagccaaagaatacaggtggcctctaggaactggaaaaggccgggacacagattctcccctggagcttctaggaggtatgcagccctgctggcaccttgattctagccaaataag

SEQ ID NO: 10627 - DNA, 601 bp, Human
tcataacaactctatgcccaagtcacactagcagatatggtatgatgggacttaggcccaggcctcctgctatggagcccaaactttttctactaaccagacagaaccatctagctaacaccaacctatcatcactctgctgaggaaagcgttgatccctgttgcatgcttggcatgttgaatcctgatttttccacctactttactctgcaatgacactgctaagtcctgcactctccagggcaactccagttttagacatgctggtcccacgacgcccatgggtgtactcacgcttgtstcacggcaaggtccgctccaggaagcttcccttgttaacccacgtctgtgcaaccctgtgtggcagtacaattcctcctcccataggacggagtatctgcacgttcctggtttgcttcagatgcaccttgtgctttctttcccagctgatcccttagttcctttcaaatccacccatcccaattggaagaccattcttaaggagggagccctggaaaccacagaatacatgatgtgtagaagaaaccacagccctgcctaaaactgttttacttactacctttacaggtggcatggtgtt

SEQ ID NO: 10628 - DNA, 601 bp, Human
tccctgtatttttcaagttttctttaatggttgtctatggcttttccagtggggaagaaaaaagacattcattctgcaacctcagggaagttagtgactttaggcatcgttgatctaggagcctcaagggcttggcaaacctccggtttctctaccccatgacatgagcatttcccgatcccgcaggattgtatggggtgaagggaagagaaagagatagagcaccaggggtttttggatatgaagtctggcagaattctgtaatgcaggattaacttaggattgtgggttctgatgattragcaaaaaaaaagctgcattttcacgcagctatggaatattcctgtttccaaaatgaccagtattccccactgagggcctctcataccccatctcccacttgccctgtctcccaggctctgtactcagagaaatgcccagtctcagcaagacagaggaggcatctaacatccactgggtcctgttccctaccgagtaccaggccagggccttcatctctgtcttctccttcaattctcaaaataatgcagaaacaaatggtgttggcccatcttaggagacaggaaaagccaaagtccaa

SEQ ID NO: 10629 - DNA, 601 bp, Human
ccttcccaaattgtcaaacaacaatgatctcactccagaaactattttctccggaaagacttggatagcgtcacgtttcaactagttgttgcttttaaagtgaagaggtggagaaggctagttgggagtgcaatggaaagacactcaaaatgttctcatcaatgatttactaaagtcattcgacttcaagtgctccttaggatataatattataggaaaaaaagcatcatacaaaattgtatgcagctataaacacacatacactaacttagaggaaggtttagaaggaaataaactaatmtcttaaaataagagtgatgaaattatggatgatttttaaatttcttactactgctcagaatattctcgacctaaggctaatcccccaactctctggcaaggtcttgactgagcacacagcctcagaagtgatgcacacgaaacagcctgggtgaaaagaggtctggtttcccagatggtccaaattactcctggtcaccaagaagacagacagcaccaactggccacacatccatcaacttccctgtatttttcaagttttctttaatggttgtctatggcttttccagtggggaagaaa

SEQ ID NO: 10630 - DNA, 601 bp, Human
ttcacagcccctcctgagctgtaaggtttgagagacaaggaagggctggtgctataacgctgtgaaagaagccactgcatgaacatgttatcaagtcctgcctggagctggactcagtttaagtccttcccaaattgtcaaacaacaatgatctcactccagaaactattttctccggaaagacttggatagcgtcacgtttcaactagttgttgcttttaaagtgaagaggtggagaaggctagttgggagtgcaatggaaagacactcaaaatgttctcatcaatgatttactaaagtmattcgacttcaagtgctccttaggatataatattataggaaaaaaagcatcatacaaaattgtatgcagctataaacacacatacactaacttagaggaaggtttagaaggaaataaactaatctcttaaaataagagtgatgaaattatggatgatttttaaatttcttactactgctcagaatattctcgacctaaggctaatcccccaactctctggcaaggtcttgactgagcacacagcctcagaagtgatgcacacgaaacagcctgggtgaaaagaggtctggtttcccagat

SEQ ID NO: 10631 - DNA, 601 bp, Human
agaaccgcctctgactagacagggttatcagaaccgcctctgactagacagggttatcagaaccgcctctgactagacagggttatcagaaccgcctctgactagacagggttatcagaaccgcctctgactagacagggttatcagaaccgcctctgactagacagggttatcagaaccgcctctgactagacagggttatcagaaccgcctctgactagacagggttatcagaaccgcctctgactagacagggttatcagaaccgcctctgactagacagggttatcagaaccgcctytgactagacagggttatcagaaccgcctttgactagacagggttatcagaaccgcctttgactagacagggttatcagaaccgcctttgactagacagggttatcagaaccgcctttgactagacatggttaacagaactgcctttgactagacagggttaacagaattgcctttaactagacagggttatcagaactttgctaaatcggccgggaactgttagcccagacccagaacccatgcttggatgctggccctggcctgctaggaatgatgctactagtaccatgcttcttctt

SEQ ID NO: 10632 - DNA, 601 bp, Human
atcacaagccctacaatttggtacctttttgcttttcaagtgaacttgagtagtggctagaaacagatagctcttttttttttttttttgagatagggtcttgctctgttgcccaggctggagtgcagtggcatgatctctgctcactgcaacctccaccttctgggctccagtggtcctcctacctcagcctcccaagtagctgggaccacaggcacacgccaccatgcctggataattttttgtagagacggggccttgctatgttacccaggctggttttgaactcctgagctcaagsaatccacccaccaccttggcctcccaaagtgctagggttacaggtgtgagccactgcacccagccccgggggagaaaaatatactcagtgcccctggtggtagggcccctgcaaggagctttatagacactgtcctgttggttcctcacaactcccttctggggtaggaaattccagagccatttcctttccattatataaggaggcctctaaaggcttttgcagtattcctggcaggggacaaggagaaacatctctgtgctggttactgccatggtttctggcagctctgcctgtgtt

SEQ ID NO: 10633 - DNA, 601 bp, Human
gattctcagctgggtgcagtggctcacatctgtaatcccaacactttggaaggctgagaagggaggattgcttgagcccaggagtttgaggctgcagtaggctactgagtgtaccactgcactccagcctagtcaacagggcaagaccctgtctcttaaaaaaaaaaaaaagattctccttgtgttactatagttttgcctgttgctaaaggccaacttcatgacgtcaaataacataccaacctgggttgcatatttctttagcttagggacatctggactcacctgatagactttgggrgtggtggctatggggtggagtgacagcaggttccctcctctgggtcagagaacaacagtcagagcccaggagggagccctggaaagaggaaggaaacctttgagcagatcagacttggagcaacttccagactcaagggagcttttggatctgggtggagctcttaggtcagtgttctgagcatgacagacactcaccccaaagatcaacatagctccatccagacctgccccacctcaccagaggcactgagcagcagaagcctgtaaataaccaactatgttgaagtatctaaaacca

SEQ ID NO: 10634 - DNA, 601 bp, Human
ctgtctgactctataatcaaaaatcacaaggagccctagttcagattctgggcttcaattttccccaatgtaaatagtcgaagcaggcaatgcactgtagacacaccgtgtgtgacaggctctgctaggaaaggcatgagatgcaaaaaaatcctcccagttagggcttgctcatgatgagtgcaaaacactaacaaacgagcctgtttgtttccaaggaaatgatctcaatatagtgaaaaggccattaaaacagattctcagctgggtgcagtggctcacatctgtaatcccaacactytggaaggctgagaagggaggattgcttgagcccaggagtttgaggctgcagtaggctactgagtgtaccactgcactccagcctagtcaacagggcaagaccctgtctcttaaaaaaaaaaaaaagattctccttgtgttactatagttttgcctgttgctaaaggccaacttcatgacgtcaaataacataccaacctgggttgcatatttctttagcttagggacatctggactcacctgatagactttgggagtggtggctatggggtggagtgacagcaggttccctcctctgggt

SEQ ID NO: 10635 - DNA, 601 bp, Human
gtgtccgggcgcggtggctcacgcctataatcccagcactttgggaggccaaggtgggcagatcacgaggtcaggagttcgagaccagtctggccaacatagtgaaactctgtctctactaaaaatacacaaaaaattagccaggtgtggtggcaggcgcctgtaatcccagctactcaggtggctgatgcaggagaattgcgtgaacccgggaggcagaggttgcagtgagccaagatcgtgccactgcactccagcctggggaacagaacgagactccatctcaaaaaaaaaaaaaaaaccccaaaaaaacaaaggtgcacttgtaggttcagcatcaccaataacaacagccagatacccactgaatactaagaagagctctatgtctttcatcaaattatagtcacgaaacgatgagtacctcaggcagttgcttggtccatgtgtatcctccaggcctggttcactgtgtctgacatatccttatgtaacctagagaaactcacttaggaaaacgggctaaatatttcctaaaattttgacagagataaagaacgcttataaggtaggacttggaaaatgtaggctaagtgccagg

SEQ ID NO: 10636 - DNA, 601 bp, Human
ctaacaaaggtgcacttgtgtccgggcgcggtggctcacgcctataatcccagcactttgggaggccaaggtgggcagatcacgaggtcaggagttcgagaccagtctggccaacatagtgaaactctgtctctactaaaaatacacaaaaaattagccaggtgtggtggcaggcgcctgtaatcccagctactcaggtggctgatgcaggagaattgcgtgaacccgggaggcagaggttgcagtgagccaagatcgtgccactgcactccagcctggggaacagaacgagactccatcycaaaaaaaaaaaaaaaaccccaaaaaaacaaaggtgcacttgtaggttcagcatcaccaataacaacagccagatacccactgaatactaagaagagctctatgtctttcatcaaattatagtcacgaaacgatgagtacctcaggcagttgcttggtccatgtgtatcctccaggcctggttcactgtgtctgacatatccttatgtaacctagagaaactcacttaggaaaacgggctaaatatttcctaaaattttgacagagataaagaacgcttataaggtaggacttggaaaat

SEQ ID NO: 10637 - DNA, 601 bp, Human
gtggggagtgtggcctacatgccagtcttctcagccgtagcctcccacaagggcagggtgagtgacagcacaccaatctcctggcacagtaataacaagtaaatgagatcattcacgtcaagggcgttttataaattagaagagactaacaaaggtgcacttgtgtccgggcgcggtggctcacgcctataatcccagcactttgggaggccaaggtgggcagatcacgaggtcaggagttcgagaccagtctggccaacatagtgaaactctgtctctactaaaaatacacaaaaaattmgccaggtgtggtggcaggcgcctgtaatcccagctactcaggtggctgatgcaggagaattgcgtgaacccgggaggcagaggttgcagtgagccaagatcgtgccactgcactccagcctggggaacagaacgagactccatctcaaaaaaaaaaaaaaaaccccaaaaaaacaaaggtgcacttgtaggttcagcatcaccaataacaacagccagatacccactgaatactaagaagagctctatgtctttcatcaaattatagtcacgaaacgatgagtacctcaggcagttgctt

SEQ ID NO: 10638 - DNA, 601 bp, Human
aatttttacagatatggaaatgaggcacagagaagccaagtaactgatccaaaaccacacagcaggtaggtggcagggctggaatttcacccatatctgtttgaccagaagcccatactccttaccactatgggaagagagcatttcaaggagggcatggccaacagagtccactacagccgagaagtcaagtacgatgagggctgagagcccatagatttatcaagacaaggtcactggggacatgggaagactattttagtggagtcacaggactgaatccaaattagactgagttaargactgagagggagtcagtgaaggaaggcagcaagtgtagacaactgttttaaggatgtggttgtgggctgggcacggtggctcacggctgtaatcccagcactttgggaggccgaggcgggagaatcacctgaggtcaggaatttgagaccagcctgaccaacatggtgaaaccctgtctccactaaaaatacaaaaattagctgggtgtggtggcacacgcttgtaatcccagctactcagaaggctgaggcagaaaaattgcttgaacccaggaggtggaggaggttgcagtgagctg

SEQ ID NO: 10639 - DNA, 601 bp, Human
aaaatctcttaataatagtaaaactttatggaattcttacaataggcgaggcatggttctaagcattttacatggattatctcattcattagtcctcccaataataaccctatgttgtggtacaattattactctaatttttacagatatggaaatgaggcacagagaagccaagtaactgatccaaaaccacacagcaggtaggtggcagggctggaatttcacccatatctgtttgaccagaagcccatactccttaccactatgggaagagagcatttcaaggagggcatggccaacrgagtccactacagccgagaagtcaagtacgatgagggctgagagcccatagatttatcaagacaaggtcactggggacatgggaagactattttagtggagtcacaggactgaatccaaattagactgagttaaggactgagagggagtcagtgaaggaaggcagcaagtgtagacaactgttttaaggatgtggttgtgggctgggcacggtggctcacggctgtaatcccagcactttgggaggccgaggcgggagaatcacctgaggtcaggaatttgagaccagcctgaccaacat

SEQ ID NO: 10640 - DNA, 601 bp, Human
ggttcctcaccagtaggagaggaatagtgccttgtctatcttataggacatgggatattcttagtcaatgtgcaatagagaaatgtatgttgtacttcaatgtttactgccttctgggaagttgtaattccactgagataacaagccattaaaatctcttaataatagtaaaactttatggaattcttacaataggcgaggcatggttctaagcattttacatggattatctcattcattagtcctcccaataataaccctatgttgtggtacaattattactctaatttttacagatatrgaaatgaggcacagagaagccaagtaactgatccaaaaccacacagcaggtaggtggcagggctggaatttcacccatatctgtttgaccagaagcccatactccttaccactatgggaagagagcatttcaaggagggcatggccaacagagtccactacagccgagaagtcaagtacgatgagggctgagagcccatagatttatcaagacaaggtcactggggacatgggaagactattttagtggagtcacaggactgaatccaaattagactgagttaaggactgagagggagtc

SEQ ID NO: 10641 - DNA, 601 bp, Human
ccctagaactcagctttggtggaacgtctcccctgctctcctaggtcctatccctgtccctccactgtgcaactcctcagacttgctggggaagtcctctctgagcagtgctgccgtgcaacctcacccacctacctgctggctgtgggcagcggtccaggttcctcaccagtaggagaggaatagtgccttgtctatcttataggacatgggatattcttagtcaatgtgcaatagagaaatgtatgttgtacttcaatgtttactgccttctgggaagttgtaattccactgagataayaagccattaaaatctcttaataatagtaaaactttatggaattcttacaataggcgaggcatggttctaagcattttacatggattatctcattcattagtcctcccaataataaccctatgttgtggtacaattattactctaatttttacagatatggaaatgaggcacagagaagccaagtaactgatccaaaaccacacagcaggtaggtggcagggctggaatttcacccatatctgtttgaccagaagcccatactccttaccactatgggaagagagcatttcaaggagggca

SEQ ID NO: 10642 - DNA, 601 bp, Human
accatgcctgggggagttatgcattggagaacttgccaactaagggctgtttctttcacaaagaaagcacagctctcccttgcttaaaaccacccctagaactcagctttggtggaacgtctcccctgctctcctaggtcctatccctgtccctccactgtgcaactcctcagacttgctggggaagtcctctctgagcagtgctgccgtgcaacctcacccacctacctgctggctgtgggcagcggtccaggttcctcaccagtaggagaggaatagtgccttgtctatcttataggayatgggatattcttagtcaatgtgcaatagagaaatgtatgttgtacttcaatgtttactgccttctgggaagttgtaattccactgagataacaagccattaaaatctcttaataatagtaaaactttatggaattcttacaataggcgaggcatggttctaagcattttacatggattatctcattcattagtcctcccaataataaccctatgttgtggtacaattattactctaatttttacagatatggaaatgaggcacagagaagccaagtaactgatccaaaaccacacagca

SEQ ID NO: 10643 - DNA, 601 bp, Human
caccatgggtttcctgcgcttgtaaacagcattaccatgcctgggggagttatgcattggagaacttgccaactaagggctgtttctttcacaaagaaagcacagctctcccttgcttaaaaccacccctagaactcagctttggtggaacgtctcccctgctctcctaggtcctatccctgtccctccactgtgcaactcctcagacttgctggggaagtcctctctgagcagtgctgccgtgcaacctcacccacctacctgctggctgtgggcagcggtccaggttcctcaccagtargagaggaatagtgccttgtctatcttataggacatgggatattcttagtcaatgtgcaatagagaaatgtatgttgtacttcaatgtttactgccttctgggaagttgtaattccactgagataacaagccattaaaatctcttaataatagtaaaactttatggaattcttacaataggcgaggcatggttctaagcattttacatggattatctcattcattagtcctcccaataataaccctatgttgtggtacaattattactctaatttttacagatatggaaatgaggcacaga

SEQ ID NO: 10644 - DNA, 601 bp, Human
gcctggtgttctcagggtgtctccaagcctggtccccacagcaatatgcccatcccactattttccctctcccctccatgtgctggtgttgattgtagaaaaagtaaagaacagagatttctgaaacgcacaggacgtgttcccaacttcctcacaagggatctcagcttgggtccaggcacctcagtagcaactaaataaatctccaagggcaagagagaagttgctcttgaaaagttttgttctcaccatgggtttcctgcgcttgtaaacagcattaccatgcctgggggagttatgsattggagaacttgccaactaagggctgtttctttcacaaagaaagcacagctctcccttgcttaaaaccacccctagaactcagctttggtggaacgtctcccctgctctcctaggtcctatccctgtccctccactgtgcaactcctcagacttgctggggaagtcctctctgagcagtgctgccgtgcaacctcacccacctacctgctggctgtgggcagcggtccaggttcctcaccagtaggagaggaatagtgccttgtctatcttataggacatgggatattcttagtcaatg

SEQ ID NO: 10645 - DNA, 601 bp, Human
aagtcagcagctgtgtgcttcagttcgctggtgtctgtgtggctgagggccgtgtgacactgccgagccagggcagcctgggatgagattacaaagtgcggaatgcgcagtggctggggagagctcggtgacagacctgcttggcgctcacatgctgggccaaccacagtcctctctggagcaccagagccagacccgggatgggctcactgtggccaaacacatacataagcttccaaggactgcggcctctgtctggggctttgaagatttcctggggggaaatccctcctaagaagcrctattcctggctctgctgacaagcaggttgggattacgtaacagaccccttgtcctcccatgccctcgtgtgtccccacctgacctgtgctgcctggtgttctcagggtgtctccaagcctggtccccacagcaatatgcccatcccactattttccctctcccctccatgtgctggtgttgattgtagaaaaagtaaagaacagagatttctgaaacgcacaggacgtgttcccaacttcctcacaagggatctcagcttgggtccaggcacctcagtagcaactaaataaatctccaa

SEQ ID NO: 10646 - DNA, 601 bp, Human
tggttaacacagggattctggaatcaggctgcccgggctggcctcctgaatctgctatttaccagcagtggctgccgtttcacccctttgtatatttaaatggggccagtaaaaatgccttgcgggtagggttgttgtgtgagttagctcgcttaacctctataaaccacttagaatagtgttggctcattaaacatcactgccttatcatggcggggtgtggggggagcttggcacaggtctttttggaggatgttcaggggtaccctttttgtcagcttaaatcacagacttccacagytaaagggcctcatgaggtgaccgaggccatgcccagtcggaagcaagaacagccaggactgacaacacccagagcctgagggagctgctcggccagtctgagccttggcggggaggctcacaccacagaggcccccttctgccctgcgtggggagctccctgaggcatgccagagcagggcacagtggccctcagcgaggcctctgaggcagggcacggggaccctcagggaggcctctgaggcagggcacagggaccatggggaccctcagcagggcctctgaggcagggcacggggac

SEQ ID NO: 10647 - DNA, 601 bp, Human
ggagcctgttcaccatgaaacatgggcagtggagaacagagctgggctatgaagaaccacctggaaaagggggcagtggagtgcggtggttaacacagggattctggaatcaggctgcccgggctggcctcctgaatctgctatttaccagcagtggctgccgtttcacccctttgtatatttaaatggggccagtaaaaatgccttgcgggtagggttgttgtgtgagttagctcgcttaacctctataaaccacttagaatagtgttggctcattaaacatcactgccttatcatggcrgggtgtggggggagcttggcacaggtctttttggaggatgttcaggggtaccctttttgtcagcttaaatcacagacttccacagttaaagggcctcatgaggtgaccgaggccatgcccagtcggaagcaagaacagccaggactgacaacacccagagcctgagggagctgctcggccagtctgagccttggcggggaggctcacaccacagaggcccccttctgccctgcgtggggagctccctgaggcatgccagagcagggcacagtggccctcagcgaggcctctgaggcaggg

SEQ ID NO: 10648 - DNA, 601 bp, Human
actggagttgacactctaggaactcggagacccacgtgtagtacagcttgtccacagggaaaggcaaggcacccagaacagcagaactcggggcagagggcgagagtgtgaggcaggatcaggtctttggggaatgtagggggtaaccaggaggtatgtgacaggaaaagtggagggatgagacaatctcaaaagagggagcaaaggggatggaaggcaatgagccaaaggcagtactggggggcgagaaacgtgtgacctgggtgtgggaggcctcccaccaccagcctccccaacctcyccctaccctgtggtctcaggcaccaacagacccaggagaaggagcaggtgggaagttgtgcataaggctgaggatgaagaggagcctgttcaccatgaaacatgggcagtggagaacagagctgggctatgaagaaccacctggaaaagggggcagtggagtgcggtggttaacacagggattctggaatcaggctgcccgggctggcctcctgaatctgctatttaccagcagtggctgccgtttcacccctttgtatatttaaatggggccagtaaaaatgccttgcgggtagggttg

SEQ ID NO: 10649 - DNA, 601 bp, Human
atgcctcccttgcaggaatgctgtcagaaacatcagtgctcttccaagtgatctctgacacatggggcatcaggacacgggagctggcattgccgtgggtgccactggagttgacactctaggaactcggagacccacgtgtagtacagcttgtccacagggaaaggcaaggcacccagaacagcagaactcggggcagagggcgagagtgtgaggcaggatcaggtctttggggaatgtagggggtaaccaggaggtatgtgacaggaaaagtggagggatgagacaatctcaaaagagrgagcaaaggggatggaaggcaatgagccaaaggcagtactggggggcgagaaacgtgtgacctgggtgtgggaggcctcccaccaccagcctccccaacctccccctaccctgtggtctcaggcaccaacagacccaggagaaggagcaggtgggaagttgtgcataaggctgaggatgaagaggagcctgttcaccatgaaacatgggcagtggagaacagagctgggctatgaagaaccacctggaaaagggggcagtggagtgcggtggttaacacagggattctggaatcaggctg

SEQ ID NO: 10650 - DNA, 601 bp, Human
cctgggtcaccttgggcaggtccctaaacttctctgatgatccgtttcctcctgtgttgatgaggataatgcctcccttgcaggaatgctgtcagaaacatcagtgctcttccaagtgatctctgacacatggggcatcaggacacgggagctggcattgccgtgggtgccactggagttgacactctaggaactcggagacccacgtgtagtacagcttgtccacagggaaaggcaaggcacccagaacagcagaactcggggcagagggcgagagtgtgaggcaggatcaggtctttgrggaatgtagggggtaaccaggaggtatgtgacaggaaaagtggagggatgagacaatctcaaaagagggagcaaaggggatggaaggcaatgagccaaaggcagtactggggggcgagaaacgtgtgacctgggtgtgggaggcctcccaccaccagcctccccaacctccccctaccctgtggtctcaggcaccaacagacccaggagaaggagcaggtgggaagttgtgcataaggctgaggatgaagaggagcctgttcaccatgaaacatgggcagtggagaacagagctgggcta

SEQ ID NO: 10651 - DNA, 601 bp, Human
tgtcagcccaggaagacgtgagaggaagccccagcatcgacgctctgtggaggtcaaggcaggcaaatcctaaagcagctaccaggctgcaccacaaagcagtgaggacagaatccagcctgcagggtgtaaggaggtggtgacagtgagcgtaggggactcccacaggtaacctagttgtgtggggacaggcggagatgggggacaaggaggatgggggattttgcagatgggatacatttgagcattcttcagattaaagagaaccattcagaagaaagtcgtgcaggatggggaaatraaggaatcaagggaatggcaaactctgaagagatcacagtagagatggagtgggaggaaggagaggctgggctgagggcgagggtgtggccatggggagatgctgaagccttaagttccaacagcagaggagttcagggaaacagggtgaccagctgtgtgacaagctgagggtgtgggctggagctcagttcagatccctgggtcaccttgggcaggtccctaaacttctctgatgatccgtttcctcctgtgttgatgaggataatgcctcccttgcaggaatgctgtcagaaacatc

SEQ ID NO: 10652 - DNA, 601 bp, Human
tgaaaccaagacttccaagactccttcagaaagcgtgacccacacagacagtcaaaagctacataggcctggtcacattttatcccaatccaaatgtctcagctcctgcagttgagcctcaacctgcctttccctcagcctgcgtgctcagagattgcctgcatcttctggtcagccccagaccctcctactgccctaggaggaacacatgtcatcaaaaggaccagcgtcatttggccctgtcccaaggatcaataacctatcaatcaccatcatggggattgggaacaacatcctggckgacagtgctcagaggacctaagtcaggactcttcatcaaaacaaagctaacatctaatgctaccttggcaaagtgagttgaatttaatagtgcctgcggaaaaaatattttcattacacatagatagggatactgaaggacatgtgaaatccctgtgcaagctgtgaactgctacacatgcaagttgttattattagtacctttgttacaatgattgatagccaaatggacaggaagttgtaaatgtgtctatttatacagattttcagctgtatagaattcaacagctttccatcagca

SEQ ID NO: 10653 - DNA, 601 bp, Human
cggaggggctgtgggacatcagaaaaccttcatctgcatggctttttggcctccaatatttgatgacttcaaagcaaagccctagccagccaaaccagaaaataagccccaggcttcacacttgatgaaatcactgaagccaccagaatgcttgtcctttgtgactctgataatagtcccagttgagtttaccttgggtagttccctgcctttcagagacagcctaaagcagtgacagcagacgctgcacatctccttctccacacttgtggcaggcatcgctgtctcctcataggagtcytctccaaggggcctgggcttgccctcagaatcctcaatgcagtcctccaagtaggttctaccaagtggtgggagctggcacacaagtcacaactactgggccaccttggttgaaaccaagacttccaagactccttcagaaagcgtgacccacacagacagtcaaaagctacataggcctggtcacattttatcccaatccaaatgtctcagctcctgcagttgagcctcaacctgcctttccctcagcctgcgtgctcagagattgcctgcatcttctggtcagccccagaccctccta

SEQ ID NO: 10654 - DNA, 601 bp, Human
agggaagcctagctgctttaagtatgtctgataccttgcaggcccgagagttccacagcctagcccaaggtcagggcggttgagtgtgcccctgacctagggtataagaagaggagtcaggagtcaagggtaggagagggtgagagctggtggctcaccagaggtcaccaccgttccttggagagggacaagacccaaggccagagctgctggccattcctaaaagcttcctaccacccttgagcccagccagaagctgccaggaaagcagtggtgtgtggagcccagcccgtttctgggrgtgagccagtgggagccacggaggggctgtgggacatcagaaaaccttcatctgcatggctttttggcctccaatatttgatgacttcaaagcaaagccctagccagccaaaccagaaaataagccccaggcttcacacttgatgaaatcactgaagccaccagaatgcttgtcctttgtgactctgataatagtcccagttgagtttaccttgggtagttccctgcctttcagagacagcctaaagcagtgacagcagacgctgcacatctccttctccacacttgtggcaggcatcgc

SEQ ID NO: 10655 - DNA, 601 bp, Human
ataaaaagtaaaaggcatgctcagcgctaagcaacaaagatggcacagaggccaggcgggtgttgttttctttcctactctaattgttgctggctgcaccataaaattatccaaatacaatgtggcacaatatgccgaagtgtcaaaggtttggaggtagcctattcttttgctgaagggcctgggcttggggtgaggcatgtgtgttaagggaacgggccttccttgtgaaaaggcctgttcgctgcagaggggagccaggcaaggtgcctgctgctcttcatttcccctgggatggctcgggggcagggaagcctagctgctttaagtatgtctgataccttgcaggcccgagagttccacagcctagcccaaggtcagggcggttgagtgtgcccctgacctagggtataagaagaggagtcaggagtcaagggtaggagagggtgagagctggtggctcaccagaggtcaccaccgttccttggagagggacaagacccaaggccagagctgctggccattcctaaaagcttcctaccacccttgagcccagccagaagctgccaggaaagcagtggtgtgtggagcccagcccgtt

SEQ ID NO: 10656 - DNA, 601 bp, Human
tttttaaagatgcattacaaagtgagttgcagacactgatgcactccaagggtagacttaatacggctctggcactctctgatggcttgtccatcacacgatccccacaacacaaacatataaaaagtaaaaggcatgctcagcgctaagcaacaaagatggcacagaggccaggcgggtgttgttttctttcctactctaattgttgctggctgcaccataaaattatccaaatacaatgtggcacaatatgccgaagtgtcaaaggtttggaggtagcctattcttttgctgaagggcstgggcttggggtgaggcatgtgtgttaagggaacgggccttccttgtgaaaaggcctgttcgctgcagaggggagccaggcaaggtgcctgctgctcttcatttcccctgggatggctggggggcagggaagcctagctgctttaagtatgtctgataccttgcaggcccgagagttccacagcctagcccaaggtcagggcggttgagtgtgcccctgacctagggtataagaagaggagtcaggagtcaagggtaggagagggtgagagctggtggctcaccagaggtcaccaccgtt

SEQ ID NO: 10657 - DNA, 601 bp, Human
ccgtatttttaaagatgcattacaaagtgagttgcagacactgatgcactccaagggtagacttaatacggctctggcactctctgatggcttgtccatcacacgatccccacaacacaaacatataaaaagtaaaaggcatgctcagcgctaagcaacaaagatggcacagaggccaggcgggtgttgttttctttcctactctaattgttgctggctgcaccataaaattatccaaatacaatgtggcacaatatgccgaagtgtcaaaggtttggaggtagcctattcttttgctgargggcctgggcttggggtgaggcatgtgtgttaagggaacgggccttccttgtgaaaaggcctgttcgctgcagaggggagccaggcaaggtgcctgctgctcttcatttcccctgggatggctggggggcagggaagcctagctgctttaagtatgtctgataccttgcaggcccgagagttccacagcctagcccaaggtcagggcggttgagtgtgcccctgacctagggtataagaagaggagtcaggagtcaagggtaggagagggtgagagctggtggctcaccagaggtcacca

SEQ ID NO: 10658 - DNA, 601 bp, Human
gagtgtgagtgtgtatgagtgtgtgagtgcaagtgtgtgtgaggaagtatttaagtgtatgtttgtgagtgggtgcaagtgtgcatgagtgtgtacaagtgtgagtgtatgtgtgttggagtgcaagtgtgagggaggatgtgtgtgagtgcgagcatctgtgtgtgttggagtgtgtgtgtgagggtgtgttggagtgtgagtgtttgttctggagtgtgagcgtgctggactgtgaaaagactagatagcaccgtcttccaaggggaccaagggcctgacagtggagtctccattttckacacaatcagaggcagaacgcagtgctacaattggtattttttaaaaaatcaactttgtattatttttttccctaatgccattatgtgaaggctgatattaatacaaccaagagtttcatttgctgagcaccactcatcaactagtgggtgactggagaggcagggtggggagacctttcattttacttccacatctgagtcagttacctggcttgttaactggatcccagcaccttccctggacgaccaatgtgtgtgacccacaatataatataggtcagaactcaactccagaaagc

SEQ ID NO: 10659 - DNA, 601 bp, Human
gggctgcccccactcagcaggtgtgaggggcaggaatatcactcggctcagaggaatgtgtgtgcttgtgagaaagcgagtgtgagtgtgtatgagtgtgtgagtgcaagtgtgtgtgaggaagtatttaagtgtatgtttgtgagtgggtgcaagtgtgcatgagtgtgtacaagtgtgagtgtatgtgtgttggagtgcaagtgtgagggaggatgtgtgtgagtgcgagcatctgtgtgtgttggagtgtgtgtgtgagggtgtgttggagtgtgagtgtttgttctggagtgtgagygtgctggactgtgaaaagactagatagcaccgtcttccaaggggaccaagggcctgacagtggagtctccattttctacacaatcagaggcagaacgcagtgctacaattggtattttttaaaaaatcaactttgtattatttttttccctaatgccattatgtgaaggctgatattaatacaaccaagagtttcatttgctgagcaccactcatcaactagtgggtgactggagaggcagggtggggagacctttcattttacttccacatctgagtcagttacctggcttgttaactg

SEQ ID NO: 10660 - DNA, 601 bp, Human
gaatgcgaggaatgcagctctggaggctggaaaggccaggaagccgatgctccctgggagcctcagagggaatgcagccctgccgacacctccatgttagcccagtgaaaatgatttcaggcttctgacctccagagctgtaagaaaataaatccgtgttgctttatgtcactaaatctgcggtcatctgttacagccatagcagaaaacacggttgttctccctgagtcctagttagaagctgaattcctgcccagggacccgaaacccagaaatggatgatttaggagcagatgctgagaacagcagcagcagcagcagcagctaacactcaccagtgcttcctatatgagcaccttacacgtagaaatgggatgaatccgcacagtgacttatggggcaggcattattgtccttgttatataaggggtgaaaccaagacccagaaaggtgaagcaatggttgatggtcacacagctagtggcagcagagccaggactcaaacccagagagtctggctccagagtccatgatctcagtgccaaagtctactgcctcctatgagcacaggcagccaggactagaacctgcagggggatgc

SEQ ID NO: 10661 - DNA, 601 bp, Human
ggcagtgggacaacagaagccaggatgctggctgctgctctgaagatggggaggatgccaagagccaaggaatgcgaggaatgcagctctggaggctggaaaggccaggaagccgatgctccctgggagcctcagagggaatgcagccctgccgacacctccatgttagcccagtgaaaatgatttcaggcttctgacctccagagctgtaagaaaataaatccgtgttgctttatgtcactaaatctgcggtcatctgttacagccatagcagaaaacacggttgttctccctgagtccyagttagaagctgaattcctgcccagggacccgaaacccagaaatggatgatttaggagcagatgctgagaacagcagcagcagcagcagcagctaacactcaccagtgcttcctatatgagcaccttacacgtagaaatgggatgaatccgcacagtgacttatggggcaggcattattgtccttgttatataaggggtgaaaccaagacccagaaaggtgaagcaatggttgatggtcacacagctagtggcagcagagccaggactcaaacccagagagtctggctccagagtccatg

SEQ ID NO: 10662 - DNA, 601 bp, Human
ctggactacagaggaaggtggcagtgggacaacagaagccaggatgctggctgctgctctgaagatggggaggatgccaagagccaaggaatgcgaggaatgcagctctggaggctggaaaggccaggaagccgatgctccctgggagcctcagagggaatgcagccctgccgacacctccatgttagcccagtgaaaatgatttcaggcttctgacctccagagctgtaagaaaataaatccgtgttgctttatgtcactaaatctgcggtcatctgttacagccatagcagaaaacacrgttgttctccctgagtcctagttagaagctgaattcctgcccagggacccgaaacccagaaatggatgatttaggagcagatgctgagaacagcagcagcagcagcagcagctaacactcaccagtgcttcctatatgagcaccttacacgtagaaatgggatgaatccgcacagtgacttatggggcaggcattattgtccttgttatataaggggtgaaaccaagacccagaaaggtgaagcaatggttgatggtcacacagctagtggcagcagagccaggactcaaacccagagag

SEQ ID NO: 10663 - DNA, 601 bp, Human; identical to SEQ ID NO: 2175

SEQ ID NO: 10664 - DNA, 601 bp, Human; identical to SEQ ID NO: 2176

SEQ ID NO: 10665 - DNA, 601 bp, Human; identical to SEQ ID NO: 2177

SEQ ID NO: 10666 - DNA, 601 bp, Human; identical to SEQ ID NO: 2178

SEQ ID NO: 10667 - DNA, 601 bp, Human; identical to SEQ ID NO: 2179

SEQ ID NO: 10668 - DNA, 601 bp, Human; identical to SEQ ID NO: 2180

SEQ ID NO: 10669 - DNA, 601 bp, Human; identical to SEQ ID NO: 2181

SEQ ID NO: 10670 - DNA, 601 bp, Human; identical to SEQ ID NO: 2182

SEQ ID NO: 10671 - DNA, 601 bp, Human; identical to SEQ ID NO: 2183

SEQ ID NO: 10672 - DNA, 601 bp, Human; identical to SEQ ID NO: 2184

SEQ ID NO: 10673 - DNA, 601 bp, Human; identical to SEQ ID NO: 2185

SEQ ID NO: 10674 - DNA, 601 bp, Human; identical to SEQ ID NO: 2186

SEQ ID NO: 10675 - DNA, 601 bp, Human; identical to SEQ ID NO: 2187

SEQ ID NO: 10676 - DNA, 601 bp, Human; identical to SEQ ID NO: 2188

SEQ ID NO: 10677 - DNA, 601 bp, Human; identical to SEQ ID NO: 2189

SEQ ID NO: 10678 - DNA, 601 bp, Human; identical to SEQ ID NO: 2190

SEQ ID NO: 10679 - DNA, 601 bp, Human; identical to SEQ ID NO: 2191

SEQ ID NO: 10680 - DNA, 601 bp, Human; identical to SEQ ID NO: 2192

SEQ ID NO: 10681 - DNA, 601 bp, Human; identical to SEQ ID NO: 2193

SEQ ID NO: 10682 - DNA, 601 bp, Human; identical to SEQ ID NO: 2194

SEQ ID NO: 10683 - DNA, 601 bp, Human; identical to SEQ ID NO: 2195

SEQ ID NO: 10684 - DNA, 601 bp, Human; identical to SEQ ID NO: 2196

SEQ ID NO: 10685 - DNA, 601 bp, Human; identical to SEQ ID NO: 2197

SEQ ID NO: 10686 - DNA, 601 bp, Human; identical to SEQ ID NO: 2198

SEQ ID NO: 10687 - DNA, 601 bp, Human; identical to SEQ ID NO: 2199

SEQ ID NO: 10688 - DNA, 601 bp, Human; identical to SEQ ID NO: 3276

SEQ ID NO: 10689 - DNA, 601 bp, Human; identical to SEQ ID NO: 3277

SEQ ID NO: 10690 - DNA, 601 bp, Human; identical to SEQ ID NO: 3278

SEQ ID NO: 10691 - DNA, 601 bp, Human; identical to SEQ ID NO: 3279

SEQ ID NO: 10692 - DNA, 601 bp, Human; identical to SEQ ID NO: 3280

SEQ ID NO: 10693 - DNA, 601 bp, Human; identical to SEQ ID NO: 3281

SEQ ID NO: 10694 - DNA, 601 bp, Human; identical to SEQ ID NO: 3282

SEQ ID NO: 10695 - DNA, 601 bp, Human; identical to SEQ ID NO: 3283

SEQ ID NO: 10696 - DNA, 601 bp, Human; identical to SEQ ID NO: 6794

SEQ ID NO: 10697 - DNA, 601 bp, Human; identical to SEQ ID NO: 6795

SEQ ID NO: 10698 - DNA, 601 bp, Human; identical to SEQ ID NO: 6796

SEQ ID NO: 10699 - DNA, 601 bp, Human; identical to SEQ ID NO: 6797

SEQ ID NO: 10700 - DNA, 601 bp, Human; identical to SEQ ID NO: 6798

SEQ ID NO: 10701 - DNA, 601 bp, Human; identical to SEQ ID NO: 6799

SEQ ID NO: 10702 - DNA, 601 bp, Human; identical to SEQ ID NO: 6800

SEQ ID NO: 10703 - DNA, 601 bp, Human; identical to SEQ ID NO: 6801

SEQ ID NO: 10704 - DNA, 601 bp, Human; identical to SEQ ID NO: 6802

SEQ ID NO: 10705 - DNA, 601 bp, Human; identical to SEQ ID NO: 6803

SEQ ID NO: 10706 - DNA, 601 bp, Human; identical to SEQ ID NO: 6804

SEQ ID NO: 10707 - DNA, 601 bp, Human; identical to SEQ ID NO: 6805

SEQ ID NO: 10708 - DNA, 601 bp, Human; identical to SEQ ID NO: 6806

SEQ ID NO: 10709 - DNA, 601 bp, Human; identical to SEQ ID NO: 6794

SEQ ID NO: 10710 - DNA, 601 bp, Human; identical to SEQ ID NO: 6795

SEQ ID NO: 10711 - DNA, 601 bp, Human; identical to SEQ ID NO: 6796

SEQ ID NO: 10712 - DNA, 601 bp, Human; identical to SEQ ID NO: 6797

SEQ ID NO: 10713 - DNA, 601 bp, Human; identical to SEQ ID NO: 6798

SEQ ID NO: 10714 - DNA, 601 bp, Human; identical to SEQ ID NO: 6799

SEQ ID NO: 10715 - DNA, 601 bp, Human; identical to SEQ ID NO: 6800

SEQ ID NO: 10716 - DNA, 601 bp, Human; identical to SEQ ID NO: 6801

SEQ ID NO: 10717 - DNA, 601 bp, Human; identical to SEQ ID NO: 6802

SEQ ID NO: 10718 - DNA, 601 bp, Human; identical to SEQ ID NO: 6803

SEQ ID NO: 10719 - DNA, 601 bp, Human; identical to SEQ ID NO: 6804

SEQ ID NO: 10720 - DNA, 601 bp, Human; identical to SEQ ID NO: 6805

SEQ ID NO: 10721 - DNA, 601 bp, Human; identical to SEQ ID NO: 6806

SEQ ID NO: 10722 - DNA, 601 bp, Human; identical to SEQ ID NO: 6794

SEQ ID NO: 10723 - DNA, 601 bp, Human; identical to SEQ ID NO: 6795

SEQ ID NO: 10724 - DNA, 601 bp, Human; identical to SEQ ID NO: 6796

SEQ ID NO: 10725 - DNA, 601 bp, Human; identical to SEQ ID NO: 6797

SEQ ID NO: 10726 - DNA, 601 bp, Human; identical to SEQ ID NO: 6798

SEQ ID NO: 10727 - DNA, 601 bp, Human; identical to SEQ ID NO: 6799

SEQ ID NO: 10728 - DNA, 601 bp, Human; identical to SEQ ID NO: 6800

SEQ ID NO: 10729 - DNA, 601 bp, Human; identical to SEQ ID NO: 6801

SEQ ID NO: 10730 - DNA, 601 bp, Human; identical to SEQ ID NO: 6802

SEQ ID NO: 10731 - DNA, 601 bp, Human; identical to SEQ ID NO: 6803

SEQ ID NO: 10732 - DNA, 601 bp, Human; identical to SEQ ID NO: 6804

SEQ ID NO: 10733 - DNA, 601 bp, Human; identical to SEQ ID NO: 6805

SEQ ID NO: 10734 - DNA, 601 bp, Human; identical to SEQ ID NO: 6806

SEQ ID NO: 10735 - DNA, 601 bp, Human; identical to SEQ ID NO: 6794

SEQ ID NO: 10736 - DNA, 601 bp, Human; identical to SEQ ID NO: 6795

SEQ ID NO: 10737 - DNA, 601 bp, Human; identical to SEQ ID NO: 6796

SEQ ID NO: 10738 - DNA, 601 bp, Human; identical to SEQ ID NO: 6797

SEQ ID NO: 10739 - DNA, 601 bp, Human; identical to SEQ ID NO: 6798

SEQ ID NO: 10740 - DNA, 601 bp, Human; identical to SEQ ID NO: 6799

SEQ ID NO: 10741 - DNA, 601 bp, Human; identical to SEQ ID NO: 6800

SEQ ID NO: 10742 - DNA, 601 bp, Human; identical to SEQ ID NO: 6801

SEQ ID NO: 10743 - DNA, 601 bp, Human; identical to SEQ ID NO: 6802

SEQ ID NO: 10744 - DNA, 601 bp, Human; identical to SEQ ID NO: 6803

SEQ ID NO: 10745 - DNA, 601 bp, Human; identical to SEQ ID NO: 6804

SEQ ID NO: 10746 - DNA, 601 bp, Human; identical to SEQ ID NO: 6805

SEQ ID NO: 10747 - DNA, 601 bp, Human; identical to SEQ ID NO: 6806

SEQ ID NO: 10748 - DNA, 601 bp, Human; identical to SEQ ID NO: 6794

SEQ ID NO: 10749 - DNA, 601 bp, Human; identical to SEQ ID NO: 6795

SEQ ID NO: 10750 - DNA, 601 bp, Human; identical to SEQ ID NO: 6796

SEQ ID NO: 10751 - DNA, 601 bp, Human; identical to SEQ ID NO: 6797

SEQ ID NO: 10752 - DNA, 601 bp, Human; identical to SEQ ID NO: 6798

SEQ ID NO: 10753 - DNA, 601 bp, Human; identical to SEQ ID NO: 6799

SEQ ID NO: 10754 - DNA, 601 bp, Human; identical to SEQ ID NO: 6800

SEQ ID NO: 10755 - DNA, 601 bp, Human; identical to SEQ ID NO: 6801

SEQ ID NO: 10756 - DNA, 601 bp, Human; identical to SEQ ID NO: 6802

SEQ ID NO: 10757 - DNA, 601 bp, Human; identical to SEQ ID NO: 6803

SEQ ID NO: 10758 - DNA, 601 bp, Human; identical to SEQ ID NO: 6804

SEQ ID NO: 10759 - DNA, 601 bp, Human; identical to SEQ ID NO: 6805

SEQ ID NO: 10760 - DNA, 601 bp, Human; identical to SEQ ID NO: 6806

SEQ ID NO: 10761 - DNA, 601 bp, Human; identical to SEQ ID NO: 6794

SEQ ID NO: 10762 - DNA, 601 bp, Human; identical to SEQ ID NO: 6795

SEQ ID NO: 10763 - DNA, 601 bp, Human; identical to SEQ ID NO: 6796

SEQ ID NO: 10764 - DNA, 601 bp, Human; identical to SEQ ID NO: 6797

SEQ ID NO: 10765 - DNA, 601 bp, Human; identical to SEQ ID NO: 6798

SEQ ID NO: 10766 - DNA, 601 bp, Human; identical to SEQ ID NO: 6799

SEQ ID NO: 10767 - DNA, 601 bp, Human; identical to SEQ ID NO: 6800

SEQ ID NO: 10768 - DNA, 601 bp, Human; identical to SEQ ID NO: 6801

SEQ ID NO: 10769 - DNA, 601 bp, Human; identical to SEQ ID NO: 6802

SEQ ID NO: 10770 - DNA, 601 bp, Human; identical to SEQ ID NO: 6803

SEQ ID NO: 10771 - DNA, 601 bp, Human; identical to SEQ ID NO: 6804

SEQ ID NO: 10772 - DNA, 601 bp, Human; identical to SEQ ID NO: 6805

SEQ ID NO: 10773 - DNA, 601 bp, Human; identical to SEQ ID NO: 6806

SEQ ID NO: 10774 - DNA, 601 bp, Human
tgtaatcccagcattttgggaggcggaggcgggcgaatcacgaggtcaggagatcgagaccattgtggcgaacacagcgaaaccccgtctctactaaaaattcaaaaaaattagccgagcgtgatacggcacgccagcagtcccagctactcgggaagttgaggcaggagaattgcttgaacccgggagacagaggttgcagtgagtcgagatcgcgcctctgcactccagcctggcgacaaaatgagactccgcctcaaaagaaagaaagaaggaacgaaagaaagagagagagagagaraaaaaagaaaagaaaactccatgtgttccctgcctgtcctgattctccccccagctctgagctcttagggttgcttcctttcgggaaaaggtttggaagaactggtgtctaataccgtcatcctctccctctccccgcaaggatcctagcgctgtttccgagggctgcagggactgtgagcccaggaccggccagcagagcgggtgcggctcagcgagcccaccccggccggtcgccgctccggggtcccgacctccagcgcggcgaccgtgcccttcctcccactcccgcctcgccccc

SEQ ID NO: 10775 - DNA, 601 bp, Human
ccaggtaggacaaagagtgctttgttttgttcttacagcagccacgcataactgggctccaaaaacgcaatactcctcaaagggagagtgagagagagggagagagggagaagggtgtgtgagagagagagcggagggagagagagagaggaggcagagtgagaggtgtgtagtggtgtgtgtgtgtgtgtgtgagagagagagagagagagagagagagagagagagagagacggagagagagattgtccctgtaggagatctacagataagaaaactccggggcgggcgcggtggctcmtgcctgtaatcccagcattttgggaggcggaggcgggcgaatcacgaggtcaggagatcgagaccattgtggcgaacacagcgaaaccccgtctctactaaaaattcaaaaaaattagccgagcgtgatacggcacgccagcagtcccagctactcgggaagttgaggcaggagaattgcttgaacccgggagacagaggttgcagtgagtcgagatcgcgcctctgcactccagcctggcgacaaaatgagactccgcctcaaaagaaagaaagaaggaacgaaagaaagagagagaga

SEQ ID NO: 10776 - DNA, 601 bp, Human
aagacagtgttctctgttttctgattttgcttaattttttaaaaatgagcctctcccttgacttggtgacacagctgtgatcttatctggccggcagggggatgctccaggtaggacaaagagtgctttgttttgttcttacagcagccacgcataactgggctccaaaaacgcaatactcctcaaagggagagtgagagagagggagagagggagaagggtgtgtgagagagagagcggagggagagagagagaggaggcagagtgagaggtgtgtagtggtgtgtgtgtgtgtgtgtgwgagagagagagagagagagagagagagagagagagagacggagagagagattgtccctgtaggagatctacagataagaaaactccggggcgggcgcggtggctcctgcctgtaatcccagcattttgggaggcggaggcgggcgaatcacgaggtcaggagatcgagaccattgtggcgaacacagcgaaaccccgtctctactaaaaattcaaaaaaattagccgagcgtgatacggcacgccagcagtcccagctactcgggaagttgaggcaggagaattgcttgaacccgggaga

SEQ ID NO: 10777 - DNA, 601 bp, Human
tgcctgggtgatggaggctcaccagtgcctcgtgaccagaaggccatctgcttcttcttgatcaggccagtgcttaatgctcagatctctgaattcaatgtaagctcaaggtttcgtgctgagcctcttgggattgccaacacctcaggggatacattttccagctcctacccatataccagtctcccagctcagcattctcatttggatcaaaagtaatttgtgcaagcctgatttgttaacacatcccaaatctgaatccgtgtgccttttaaaggtggcaagctgccatttatgagcyatacgcacctctccttcctcatcaccactgcagtaatcccaagaaccacaggcatgaataaaagcccgaacttttcgtttttggtgacagaaatttctcttacaagctccaggagatgatgaggaagacagtgttctctgttttctgattttgcttaattttttaaaaatgagcctctcccttgacttggtgacacagctgtgatcttatctggccggcagggggatgctccaggtaggacaaagagtgctttgttttgttcttacagcagccacgcataactgggctccaaaaacgcaa

SEQ ID NO: 10778 - DNA, 601 bp, Human
ggaattcaaagtaatacaatatgagcaaataataatggtaataatgtcttacattatgcttcagggcatattcatttgtttattagtttttacaagtggaccaggtatagcaatctcattcccattttgtagatgggaaattcgagacagagaaacattaacttcccactgtaactccaaaaaatagcctacgcccatctactgctaccaccccccatcagtaaactcgcttctggccttcttctgtcccctctccttcccctgtaatccattctccacatagcacccagagtcatctctytataaagtaaatcaattatgtcacatctctgcttcaaactctcttttggcttctctcattgtaaagagtaaaatccaaatgtttcccttggcctatgagggtcttcctgacctggctcctgcccctaaagctcactcctccaactctccttctccctcacctaactccagccacactggcattccaactgtgcctccaacacatcacacctgttcccaggagcaggacatttgtgcttgtggttccctctgcagggacgtctgcccatcttcctgaggtttcatctccaggccttcttgc

SEQ ID NO: 10779 - DNA, 601 bp, Human
gaaaattcaagagcttcctctgagagagaatgcttcactaagggaaacaaccctacccaactctggtccacagacttctccagaaattctgctgccatatagatattttcagttatctacaaatctttgcactcacagatatctgcatgaccacagccaggacaaaggcaaatctgtccaaaatatttttttcccattcccagctttaattattctatttttgaatttttatctgaccatattcaacttttgaaattaagccagctattattttagcaataatttccctgcattttgtgaygacttgtttttattggtaactcttagttaagagtttccagttctccgaacagagaaagatacttttatgtataataaattaggtttactgaaaataatataataagacatcaaatttattaaaataaattttaagataaagcacagggaattcaaagtaatacaatatgagcaaataataatggtaataatgtcttacattatgcttcagggcatattcatttgtttattagtttttacaagtggaccaggtatagcaatctcattcccattttgtagatgggaaattcgagacagagaa

SEQ ID NO: 10780 - DNA, 601 bp, Human
catccaaatgcactagtgcccatcccataggcaagattagaaatgaagtgctatccctcaaactttacccacccacttatctgatgtcatatgtacacaccaaaatgaataaaatatggtagaaaaataagatagtgtttgtacatacagttacccttctaagcatttcatataaatgaactcatttagtcctcagagttctttgacatacagttgagataatgaagacaaagaggttaaataacgtgcccaagttcacaaggataggaagtagctaaaccaggatctgaacctagaccckgaccctaaagtaggaattcttaagctcagcactgctgacactaggggctgataagtcttggctgtgggggctgtcctgtgcattgcagggtgtttagcaacatccctggcctctacccactagatgccaatagcacaccccagttgtggcaactaaatattacgtctccagacattgccagatgtcccctggagtgggggcataaatcatcctcagctgaaaaccattgctctcaagctgtacattgagcagttctcctgtaaactctcaggaacaatctaactggaaaataagccctga

SEQ ID NO: 10781 - DNA, 601 bp, Human
tgtttaataaggaagaaatatttatttcattctagggaggcagatgcatgagatgcaaaacctgcaagtaacatataattagttgattctactcacaattttggaaatgggaattaatctgcatcccatgtgcaaatgtccaaatgtttggtgttctatatggcttaaaggtcataaaaggtaaaagttgtctaagatcaatgggcagcctgctgctatactgtaagttcctgatcttactctcagactcagtcccccaactatattactcacaatagtaagagtaagagtaactggatckgttgagtgttgtatgcataaatggctacatgatggttaggttaaggtcatgggtatacttcttgagaaaacttacctgtatcagaataataaagtggtttagaaatttagctccagtttctggctgccaaggtttgaatcttgaatctgctacttactagtttggtgacttcagttaagttcttacctactttctgcttttctctcctcatctgtcaaagaggaaccctgataatggggttcttatggggatgtgagcccttggagaaatgctattattattatccaaagtctaccaatt

SEQ ID NO: 10782 - DNA, 601 bp, Human
ctagctgacctctgaaggttcactgaacctgttattttagcctagtaaggccatgtcagacttctgactttcagaaccatgagataataaattatgttgctttaagtgactaaatttgtagaaaatttttacagcagcaatagaaaactaatatggagcatataaagtaactgaatgagacaaaaagcaaataatagcccaattcagtttcaactaaagtcaaagaaagtggcttaaatacctcaaaactgacccattaccacaccaaatgattgctgaagaagataaaatcttctttggrtattttacaataggatgaaggctggagaatgcagctagaacatcactctacagcagtgtctctcaactaaggcatttttgccccccaagaagacacttattaatgtctggagatatttttggttgccacaaccaggagggggctgctactggcatctagtgagtagcagtcagggatgctgttaagcatcctgtagtgcacaggacagccctacaacatagaggaatctcaaaatgtcaataatgctgaggttgagaaaccctggtctaagaaaatgctggggcaactctatccttgttt

SEQ ID NO: 10783 - DNA, 601 bp, Human
ccacctccatgcccggctaatttttgtatttttagtagagatggggtttcaccatgttggccaggatggtcttgatctcctgacctcatgatctgcccaccttggcctcccaaagtgctgggattacagtcatcagccgccgtgtccagccaaaacttcttaaactacttgcagagggactgtatttccttattcaacatctttcttttgatcagaaaaaaaaggtatatatgtgcaactctttaagattatttataattttggttgattttatttgatcttatttcagtattatatttarttatattataaagttaatacatgatttcaaaaatccaaacataacagaaaaaggtaaattgagttatctcttcgcaaataatgacttgctaacagatttttttccagaggcatttctaggctcgaatacatgcacactgaaggggccaagggggccacgggtggcattccccttggacctctgaagggtcactgaaaaatcaacttgtaaaaggcagattatttatttaatgtgtattcacaaggagccttcagaatgaagacccaaagatacaggggaaactgtctatttttatgcata

SEQ ID NO: 10784 - DNA, 601 bp, Human; identical to SEQ ID NO: 3266

SEQ ID NO: 10785 - DNA, 601 bp, Human; identical to SEQ ID NO: 3267

SEQ ID NO: 10786 - DNA, 601 bp, Human; identical to SEQ ID NO: 3268

SEQ ID NO: 10787 - DNA, 601 bp, Human; identical to SEQ ID NO: 3269

SEQ ID NO: 10788 - DNA, 601 bp, Human; identical to SEQ ID NO: 3270

SEQ ID NO: 10789 - DNA, 601 bp, Human; identical to SEQ ID NO: 3271

SEQ ID NO: 10790 - DNA, 601 bp, Human; identical to SEQ ID NO: 3272

SEQ ID NO: 10791 - DNA, 601 bp, Human; identical to SEQ ID NO: 3273

SEQ ID NO: 10792 - DNA, 601 bp, Human; identical to SEQ ID NO: 3274

SEQ ID NO: 10793 - DNA, 601 bp, Human; identical to SEQ ID NO: 3275

SEQ ID NO: 10794 - DNA, 601 bp, Human; identical to SEQ ID NO: 1525

SEQ ID NO: 10795 - DNA, 601 bp, Human; identical to SEQ ID NO: 1526

SEQ ID NO: 10796 - DNA, 601 bp, Human; identical to SEQ ID NO: 1527

SEQ ID NO: 10797 - DNA, 601 bp, Human; identical to SEQ ID NO: 1528

SEQ ID NO: 10798 - DNA, 601 bp, Human; identical to SEQ ID NO: 1529

SEQ ID NO: 10799 - DNA, 601 bp, Human; identical to SEQ ID NO: 1530

SEQ ID NO: 10800 - DNA, 601 bp, Human; identical to SEQ ID NO: 1531

SEQ ID NO: 10801 - DNA, 601 bp, Human; identical to SEQ ID NO: 1532

SEQ ID NO: 10802 - DNA, 601 bp, Human; identical to SEQ ID NO: 1533

SEQ ID NO: 10803 - DNA, 601 bp, Human; identical to SEQ ID NO: 1534

SEQ ID NO: 10804 - DNA, 601 bp, Human; identical to SEQ ID NO: 1535

SEQ ID NO: 10805 - DNA, 601 bp, Human; identical to SEQ ID NO: 1536

SEQ ID NO: 10806 - DNA, 601 bp, Human; identical to SEQ ID NO: 1537

SEQ ID NO: 10807 - DNA, 601 bp, Human; identical to SEQ ID NO: 1538

SEQ ID NO: 10808 - DNA, 601 bp, Human; identical to SEQ ID NO: 1539

SEQ ID NO: 10809 - DNA, 601 bp, Human; identical to SEQ ID NO: 1540

SEQ ID NO: 10810 - DNA, 601 bp, Human; identical to SEQ ID NO: 1541

SEQ ID NO: 10811 - DNA, 601 bp, Human; identical to SEQ ID NO: 1542

SEQ ID NO: 10812 - DNA, 601 bp, Human; identical to SEQ ID NO: 1543

SEQ ID NO: 10813 - DNA, 601 bp, Human; identical to SEQ ID NO: 1544

SEQ ID NO: 10814 - DNA, 601 bp, Human; identical to SEQ ID NO: 1545

SEQ ID NO: 10815 - DNA, 601 bp, Human; identical to SEQ ID NO: 1546

SEQ ID NO: 10816 - DNA, 601 bp, Human; identical to SEQ ID NO: 1547

SEQ ID NO: 10817 - DNA, 601 bp, Human; identical to SEQ ID NO: 1548

SEQ ID NO: 10818 - DNA, 601 bp, Human; identical to SEQ ID NO: 1549

SEQ ID NO: 10819 - DNA, 601 bp, Human; identical to SEQ ID NO: 1550

SEQ ID NO: 10820 - DNA, 601 bp, Human; identical to SEQ ID NO: 1551

SEQ ID NO: 10821 - DNA, 601 bp, Human; identical to SEQ ID NO: 1552

SEQ ID NO: 10822 - DNA, 601 bp, Human; identical to SEQ ID NO: 1553

SEQ ID NO: 10823 - DNA, 601 bp, Human; identical to SEQ ID NO: 1554
